US011725045B2

(12) United States Patent
Walker

(10) Patent No.: US 11,725,045 B2
(45) Date of Patent: Aug. 15, 2023

(54) ANTI-RESPIRATORY SYNCYTIAL VIRUS ANTIBODIES, METHODS OF THEIR GENERATION AND USE

(71) Applicant: Mapp Biopharmaceutical, Inc., San Diego, CA (US)

(72) Inventor: Laura M. Walker, Lebanon, NH (US)

(73) Assignee: Mapp Biopharmaceutical, Inc., San Diego, CA (US)

( * ) Notice: Subject to any disclaimer, the term of this patent is extended or adjusted under 35 U.S.C. 154(b) by 0 days.

(21) Appl. No.: 16/754,848

(22) PCT Filed: Oct. 12, 2018

(86) PCT No.: PCT/US2018/055750
§ 371 (c)(1),
(2) Date: Apr. 9, 2020

(87) PCT Pub. No.: WO2019/075433
PCT Pub. Date: Apr. 18, 2019

(65) Prior Publication Data
US 2020/0239550 A1 Jul. 30, 2020

Related U.S. Application Data

(60) Provisional application No. 62/572,400, filed on Oct. 13, 2017.

(51) Int. Cl.
*C07K 16/10* (2006.01)
(52) U.S. Cl.
CPC ...... *C07K 16/1027* (2013.01); *C07K 2317/21* (2013.01); *C07K 2317/565* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 2014/0141044 A1 | 5/2014 | Bhatt et al. | |
| 2014/0271653 A1* | 9/2014 | Gurnett-Bander | A61P 31/14 424/139.1 |
| 2015/0118233 A1 | 4/2015 | Depla et al. | |
| 2019/0075433 A1 | 3/2019 | Shan et al. | |

FOREIGN PATENT DOCUMENTS

| | | | |
|---|---|---|---|
| WO | WO-0198361 A2 * | 12/2001 | ......... C07K 16/2863 |
| WO | WO-2017/075124 A1 | 5/2017 | |
| WO | WO-2017/172890 A1 | 10/2017 | |

OTHER PUBLICATIONS

D'Angelo et al., Front Immunol. Mar. 8, 2018;9:395. doi: 10.3389/fimmu.2018.00395. eCollection 2018.*
Janeway et al., Immunobiology, 3rd edition, 1997 Garland Publishing Inc., pp. 3:1-3:11.*
Rudikoff et al., Proc Natl Acad Sci USA. Mar. 1982;79(6):1979-83.*
Edwards et al., J Mol Biol. Nov. 14, 2003;334(1):103-18.*
Lloyd et al., Protein Eng Des Sel. Mar. 2009;22(3):159-68. doi: 10.1093/protein/gzn058. Epub Oct. 29, 2008.*
Goel et al., J Immunol. Dec. 15, 2004;173(12):7358-67.*
Kanyavuz et al., Nat Rev Immunol. Jun. 2019;19(6):355-368. doi: 10.1038/S41577-019-0126-7.*
Harkensee et al., J Infect. Jan. 2006;52(1):2-8. doi: 10.1016/j.jinf.2005.08.003. Epub Oct. 19, 2005. PMID: 16236360.*
Villafana et al., Expert Rev Vaccines. Jul. 2017;16(7):1-13. doi: 10.1080/14760584.2017.1333425. Epub Jun. 7, 2017. PMID: 28525961.*
Janet et al., Hum Vaccin Immunother. Jan. 2, 2018;14(1):234-244. doi: 10.1080/21645515.2017.1403707. Epub Dec. 15, 2017. PMID: 29194014.*
Pons et al., Acta Paediatr. Mar. 2011;100(3):324-9. doi: 10.1111/j.1651-2227.2010.02059.x. Epub Nov. 9, 2010. PMID: 20950412.*
GenPept_S31669, Ig heavy chain V region-human (fragment), online Jul. 23, 1999, https://www.ncbi.nlm.nih.gov/protein/S31669>Definition, and Origin, retrieved on Dec. 6, 2018 (2 pages).
International Search Report for PCT/US2018/55750 (Anti-Respiratory Syncytial Virus Antibodies, Methods of Their Generation and Use, filed Oct. 12, 2018), issued by ISA/US, 7 pages (dated Feb. 11, 2019).
Mclellan, J. et al., Structure of Respiratory Syncytial Virus Fusion Glycoprotein in the Postfusion Conformation Reveals Preservation of Neutralizing Epitopes, Journal of Virology, 85(15):7788-7796 (2011).
Written Opinion for PCT/US2018/55750 (Anti-Respiratory Syncytial Virus Antibodies, Methods of Their Generation and Use, filed Oct. 12, 2018), issued by ISA/US, 16 pages (dated Feb. 11, 2019).
Acosta, P. L. et al., Brief History and Characterization of Enhanced Respiratory Syncytial Virus Disease, Clin Vaccine Immunol, 23:189-195 (2015).
Adams, P. D. et al., PHENIX: building new software for automated crystallographic structure determination, Acta Crystallogr D Biol Crystallogr, 58:1948-1954 (2002).
Anderson, L. J. et al., Identification of epitopes on respiratory syncytial virus proteins by competitive binding immunoassay, J Clin Microbiol, 23:475-480 (1986).
Anderson, L. J. et al., Strategic priorities for respiratory syncytial virus (RSV) vaccine development, Vaccine, 31(Suppl 2):B209-215 (2013).
Bailey, J. R. et al., Broadly neutralizing antibodies with few somatic mutations and hepatitis C virus clearance, JCI Insight, 2(9):e92872 (2017).

(Continued)

*Primary Examiner* — Michael Szperka
(74) *Attorney, Agent, or Firm* — Choate, Hall & Stewart LLP; Brenda Herschbach Jarrell; Aaron J. Ogden

(57) ABSTRACT

Provided are antibodies or antigen binding polypeptides characterized by the ability to neutralize respiratory syncytial virus (RSV). Specifically, the antibodies or antigen binding polypeptides are characterized by high affinity binding to RSV fusion glycoprotein (RSVF). Further provided are methods for their identification, isolation, generation, preparation, and use, as well as the heavy chain and light chain sequences of the antibodies provided.

45 Claims, 33 Drawing Sheets
Specification includes a Sequence Listing.

(56) References Cited

OTHER PUBLICATIONS

Battles, M. B. et al., Molecular mechanism of respiratory syncytial virus fusion inhibitors, Nat Chem Biol, 12:87-93 (2016).
Battye, T. G. et al., iMOSFLM: a new graphical interface for diffraction-image processing with MOSFLM, Acta Crystallogr D Biol Crystallogr, 67:271-281 (2011).
Beeler, J. A. and Van Wyck Coelingh, K., Neutralization epitopes of the F glycoprotein of respiratory syncytial virus: effect of mutation upon fusion function, J Virol, 63:2941-2950 (1989).
Bornholdt, Z. A. et al., Isolation of potent neutralizing antibodies from a survivor of the 2014 Ebola virus outbreak, Science, 351:1078-1083 (2016).
Chin, J. et al., Field evaluation of a respiratory syncytial virus vaccine and a trivalent parainfluenza virus vaccine in a pediatric population, Am J Epidemiol, 89:449-463 (1969).
Collaborative Computational Project, No. 4, The CCP4 suite: programs for protein crystallography, Acta Crystallogr D Biol Crystallogr, 50(Pt 5):760-3 (1994).
Corti, D., Bianchi, S., Vanzetta, F., Minola, A., Perez, L., Agatic, G., Guarino, B., Silacci, C., Marcandalli, J., Marsland, B.J., et al. (2013). Cross-neutralization of four paramyxoviruses by a human monoclonal antibody. Nature 501, 439-443.
Crooks, G.E., Hon, G., Chandonia, J.M., and Brenner, S.E. (2004). WebLogo: a sequence logo generator. Genome Res 14, 1188-1190.
DeKosky, B.J., Ippolito, G.C., Deschner, R.P., Lavinder, J.J., Wine, Y., Rawlings, B.M., Varadarajan, N., Giesecke, C., Dorner, T., Andrews, S.F., et al. (2013). High-throughput sequencing of the paired human immunoglobulin heavy and light chain repertoire. Nat Biotechnol 31, 166-169.
Doria-Rose, N.A., Klein, R.M., Daniels, M.G., O'Dell, S., Nason, M., Lapedes, A., Bhattacharya, T., Migueles, S.A., Wyatt, R.T., Korber, B.T., et al. (2010). Breadth of human immunodeficiency virus-specific neutralizing activity in sera: clustering analysis and association with clinical variables. J Virol 84, 1631-1636.
Ekiert, D.C., Bhabha, G., Elsliger, M.A., Friesen, R.H., Jongeneelen, M., Throsby, M., Goudsmit, J., and Wilson, I.A. (2009). Antibody recognition of a highly conserved influenza virus epitope. Science 324, 246-251.
Emsley, P., and Cowtan, K. (2004). Coot: model-building tools for molecular graphics. Acta Crystallogr D Biol Crystallogr 60, 2126-2132.
Esposito, S., Scarselli, E., Lelii, M., Scala, A., Vitelli, A., Capone, S., Fornili, M., Biganzoli, E., Orenti, A., Nicosia, A., et al. (2016). Antibody response to respiratory syncytial virus infection in children <18 months old. Hum Vaccin Immunother 12, 1700-1706.
Evans, P.R., and Murshudov, G.N. (2013). How good are my data and what is the resolution? Acta Crystallogr D Biol Crystallogr 69, 1204-1214.
Fuentes, S., Coyle, E.M., Beeler, J., Golding, H., and Khurana, S. (2016). Antigenic Fingerprinting following Primary RSV Infection in Young Children Identifies Novel Antigenic Sites and Reveals Unlinked Evolution of Human Antibody Repertoires to Fusion and Attachment Glycoproteins. PLoS Pathog 12, e1005554.
Fulginiti, V.A., Eller, J.J., Sieber, O.F., Joyner, J.W., Minamitani, M., and Meiklejohn, G. (1969). Respiratory virus immunization. I. A field trial of two inactivated respiratory virus vaccines; an aqueous trivalent parainfluenza virus vaccine and an alum-precipitated respiratory syncytial virus vaccine. Am J Epidemiol 89, 435-448.
Gans, H., Yasukawa, L., Rinki, M., DeHovitz, R., Forghani, B., Beeler, J., Audet, S., Maldonado, Y., and Arvin, A.M. (2001). Immune responses to measles and mumps vaccination of infants at 6, 9, and 12 months. J Infect Dis 184, 817-826.
Garcia-Barreno, B., Palomo, C., Penas, C., Delgado, T., Perez-Brena, P., and Melero, J.A. (1989). Marked differences in the antigenic structure of human respiratory syncytial virus F and G glycoproteins. J Virol 63, 925-932.

Gietz, R.D., and Schiestl, R.H. (2007). High-efficiency yeast transformation using the LiAc/SS carrier DNA/PEG method. Nat Protoc 2, 31-34.
Gilman, M.S., Castellanos, C.A., Chen, M., Ngwuta, J.O., Goodwin, E., Moin, S.M., Mas, V., Melero, J.A., Wright, P.F., Graham, B.S., et al. (2016). Rapid profiling of RSV antibody repertoires from the memory B cells of naturally infected adult donors. Sci Immunol 1.
Gilman, M.S., Moin, S.M., Mas, V., Chen, M., Patel, N.K., Kramer, K., Zhu, Q., Kabeche, S.C., Kumar, A., Palomo, C., et al. (2015). Characterization of a Prefusion-Specific Antibody That Recognizes a Quaternary, Cleavage-Dependent Epitope on the RSV Fusion Glycoprotein. PLoS Pathog 11, e1005035.
Gray, E.S., Madiga, M.C., Hermanus, T., Moore, P.L., Wibmer, C.K., Tumba, N.L., Werner, L., Mlisana, K., Sibeko, S., Williamson, C., et al. (2011). The neutralization breadth of HIV-1 develops incrementally over four years and is associated with CD4+ T cell decline and high viral load during acute infection. J Virol 85, 4828-4840.
Griffin, M.P., Khan, A.A., Esser, M.T., Jensen, K., Takas, T., Kankam, M.K., Villafana, T., and Dubovsky, F. (2017). Safety, Tolerability, and Pharmacokinetics of MEDI8897, the Respiratory Syncytial Virus Prefusion F-Targeting Monoclonal Antibody with an Extended Half-Life, in Healthy Adults. Antimicrob Agents Chemother 61.
Group, T.I.-R.S. (1998). Palivizumab, a humanized respiratory syncytial virus monoclonal antibody, reduces hospitalization from respiratory syncytial virus infection in high-risk infants. Pediatrics 102, 531-537.
Hall, C.B., Walsh, E.E., Long, C.E., and Schnabel, K.C. (1991). Immunity to and frequency of reinfection with respiratory syncytial virus. J Infect Dis 163, 693-698.
Henderson, F.W., Collier, A.M., Clyde, W.A., Jr., and Denny, F.W. (1979). Respiratory-syncytial-virus infections, reinfections and immunity. A prospective, longitudinal study in young children. N Engl J Med 300, 530-534.
Homaira, N., Rawlinson, W., Snelling, T.L., and Jaffe, A. (2014). Effectiveness of Palivizumab in Preventing RSV Hospitalization in High Risk Children: A Real-World Perspective. Int J Pediatr 2014, 571609.
Huang, K., Incognito, L., Cheng, X., Ulbrandt, N.D., and Wu, H. (2010). Respiratory syncytial virus-neutralizing monoclonal antibodies motavizumab and palivizumab inhibit fusion. J Virol 84, 8132-8140.
IJspeert, H., van Schouwenburg, P.A., van Zessen, D., Pico-Knijnenburg, I., Driessen, G.J., Stubbs, A.P., and van der Burg, M. (2016). Evaluation of the Antigen-Experienced B-Cell Receptor Repertoire in Healthy Children and Adults. Front Immunol 7, 410.
Jain, T., Sun, T., Durand, S., Hall, A., Houston, N.R., Nett, J.H., Sharkey, B., Bobrowicz, B., Caffry, I., Yu, Y., et al. (2017). Biophysical properties of the clinical-stage antibody landscape. Proc Natl Acad Sci U S A 114, 944-949.
Jans, J., Pettengill, M., Kim, D., van der Made, C., de Groot, R., Henriet, S., de Jonge, M.I., Ferwerda, G., and Levy, O. (2016). Human newborn B cells mount an interferon-alpha/beta receptor-dependent humoral response to respiratory syncytial virus. J Allergy Clin Immunol.
Jardine, J.G., Kulp, D.W., Havenar-Daughton, C., Sarkar, A., Briney, B., Sok, D., Sesterhenn, F., Ereno-Orbea, J., Kalyuzhniy, O., Deresa, I., et al. (2016). HIV-1 broadly neutralizing antibody precursor B cells revealed by germline-targeting immunogen. Science 351, 1458-1463.
Kamal-Bahl, S., Doshi, J., and Campbell, J. (2002). Economic analyses of respiratory syncytial virus immunoprophylaxis in high-risk infants: a systematic review. Arch Pediatr Adolesc Med 156, 1034-1041.
Kapikian, A.Z., Mitchell, R.H., Chanock, R.M., Shvedoff, R.A., and Stewart, C.E. (1969). An epidemiologic study of altered clinical reactivity to respiratory syncytial (RS) virus infection in children previously vaccinated with an inactivated RS virus vaccine. Am J Epidemiol 89, 405-421.
Kashyap, A.K., Steel, J., Oner, A.F., Dillon, M.A., Swale, R.E., Wall, K.M., Perry, K.J., Faynboym, A., Ilhan, M., Horowitz, M., et al. (2008). Combinatorial antibody libraries from survivors of the

(56) References Cited

OTHER PUBLICATIONS

Turkish H5N1 avian influenza outbreak reveal virus neutralization strategies. Proc Natl Acad Sci U S A 105, 5986-5991.

Kelly, R.L., Sun, T., Jain, T., Caffry, I., Yu, Y., Cao, Y., Lynaugh, H., Brown, M., Vasquez, M., Wittrup, K.D., et al. (2015). High throughput cross-interaction measures for human IgG1 antibodies correlate with clearance rates in mice. MAbs, 0.

Killikelly, A.M., Kanekiyo, M., and Graham, B.S. (2016). Prefusion F is absent on the surface of formalin-inactivated respiratory syncytial virus. Sci Rep 6, 34108.

Kim, H.W., Canchola, J.G., Brandt, C.D., Pyles, G., Chanock, R.M., Jensen, K., and Parrott, R.H. (1969). Respiratory syncytial virus disease in infants despite prior administration of antigenic inactivated vaccine. Am J Epidemiol 89, 422-434.

Krarup, A., Truan, D., Furmanova-Hollenstein, P., Bogaert, L., Bouchier, P., Bisschop, I.J., Widjojoatmodjo, M.N., Zahn, R., Schuitemaker, H., McLellan, J.S., et al. (2015). A highly stable prefusion RSV F vaccine derived from structural analysis of the fusion mechanism. Nat Commun 6, 8143.

Kristjansson, S., Bjarnarson, S.P., Wennergren, G., Palsdottir, A.H., Arnadottir, T., Haraldsson, A., and Jonsdottir, I. (2005). Respiratory syncytial virus and other respiratory viruses during the first 3 months of life promote a local TH2-like response. J Allergy Clin Immunol 116, 805- 811.

Lambert, D.M., Barney, S., Lambert, A.L., Guthrie, K., Medinas, R., Davis, D.E., Bucy, T., Erickson, J., Merutka, G., and Petteway, S.R., Jr. (1996). Peptides from conserved regions of paramyxovirus fusion (F) proteins are potent inhibitors of viral fusion. Proc Natl Acad Sci U S A 93, 2186-2191.

Lambert, L., Sagfors, A.M., Openshaw, P.J., and Culley, F.J. (2014). Immunity to RSV in Early-Life. Front Immunol 5, 466.

Legg, J.P., Hussain, I.R., Warner, J.A., Johnston, S.L., and Warner, J.O. (2003). Type 1 and type 2 cytokine imbalance in acute respiratory syncytial virus bronchiolitis. Am J Respir Crit Care Med 168, 633-639.

Lerner, R.A. (2011). Rare antibodies from combinatorial libraries suggests an S.O.S. component ofthe human immunological repertoire. Mol Biosyst 7, 1004-1012.

Magro, M., Mas, V., Chappell, K., Vazquez, M., Cano, O., Luque, D., Terron, M.C., Melero, J.A., and Palomo, C. (2012). Neutralizing antibodies against the preactive form of respiratory syncytial virus fusion protein offer unique possibilities for clinical intervention. Proc Natl Acad Sci U S A 109, 3089-3094.

McCoy, A.J., Grosse-Kunstleve, R.W., Adams, P.D., Winn, M.D., Storoni, L.C., and Read, R.J. (2007). Phaser crystallographic software. J Appl Crystallogr 40, 658-674.

McLellan, J.S., Chen, M., Chang, J.S., Yang, Y., Kim, A., Graham, B.S., and Kwong, P.D. (2010a). Structure of a major antigenic site on the respiratory syncytial virus fusion glycoprotein in complex with neutralizing antibody 101F. J Virol 84, 12236-12244.

McLellan, J.S., Chen, M., Kim, A., Yang, Y., Graham, B.S., and Kwong, P.D. (2010b). Structural basis of respiratory syncytial virus neutralization by motavizumab. Nat Struct Mol Biol 17, 248-250.

McLellan, J.S., Chen, M., Leung, S., Graepel, K.W., Du, X., Yang, Y., Zhou, T., Baxa, U., Yasuda, E., Beaumont, T., et al. (2013). Structure of RSV fusion glycoprotein trimer bound to a prefusion-specific neutralizing antibody. Science 340, 1113-1117.

McLellan, J.S., Yang, Y., Graham, B.S., and Kwong, P.D. (2011). Structure of respiratory syncytial virus fusion glycoprotein in the postfusion conformation reveals preservation of neutralizing epitopes. J Virol 85, 7788-7796.

Morin, A., Eisenbraun, B., Key, J., Sanschagrin, P.C., Timony, M.A., Ottaviano, M., and Sliz, P. (2013). Collaboration gets the most out of software. Elife 2, e01465.

Mousa, J.J., Kose, N., Matta, P., Gilchuk, P., and Crowe, J.E., Jr. (2017). A novel pre-fusion conformation-specific neutralizing epitope on the respiratory syncytial virus fusion protein. Nat Microbiol 2, 16271.

Murphy, B.R., Alling, D.W., Snyder, M.H., Walsh, E.E., Prince, G.A., Chanock, R.M., Hemming, V.G., Rodriguez, W.J., Kim, H.W., Graham, B.S., et al. (1986). Effect of age and preexisting antibody on serum antibody response of infants and children to the F and G glycoproteins during respiratory syncytial virus infection. J Clin Microbiol 24, 894-898.

Murphy, B.R., and Walsh, E.E. (1988). Formalin-inactivated respiratory syncytial virus vaccine induces antibodies to the fusion glycoprotein that are deficient in fusion-inhibiting activity. J Clin Microbiol 26, 1595-1597.

Ngwuta, J.O., Chen, M., Modjarrad, K., Joyce, M.G., Kanekiyo, M., Kumar, A., Yassine, H.M., Moin, S.M., Killikelly, A.M., Chuang, G.Y., et al. (2015). Prefusion F-specific antibodies determine the magnitude of RSV neutralizing activity in human sera. Sci Transl Med 7, 309ra162.

Panda, S., and Ding, J.L. (2015). Natural antibodies bridge innate and adaptive immunity. J Immunol 194, 13-20.

Path, RSV Vaccine and mAb Snapshot. Updated Sep. 28, 2021. URL: https://www.path.org/resources/rsv-vaccine-and-mab-snapshot/.

Polack, F.P., Teng, M.N., Collins, P.L., Prince, G.A., Exner, M., Regele, H., Lirman, D.D., Rabold, R., Hoffman, S.J., Karp, C.L., et al. (2002). A role for immune complexes in enhanced respiratory syncytial virus disease. J Exp Med 196, 859-865.

Potterton, E., Briggs, P., Turkenburg, M., and Dodson, E. (2003). A graphical user interface to the CCP4 program suite. Acta Crystallogr D Biol Crystallogr 59, 1131-1137.

Rechavi, E., Lev, A., Lee, Y.N., Simon, A.J., Yinon, Y., Lipitz, S., Amariglio, N., Weisz, B., Notarangelo, L.D., and Somech, R. (2015). Timely and spatially regulated maturation of B and T cell repertoire during human fetal development. Sci Transl Med 7, 276ra225.

Reed, J.H., Jackson, J., Christ, D., and Goodnow, C.C. (2016). Clonal redemption of autoantibodies by somatic hypermutation away from self-reactivity during human immunization. J Exp Med 213, 1255-1265.

Reichert, J.M. (2016). Antibodies to watch in 2016. MAbs 8, 197-204.

Ridings, J., Dinan, L., Williams, R., Roberton, D., and Zola, H. (1998). Somatic mutation of immunoglobulin V(H)6 genes in human infants. Clin Exp Immunol 114, 33-39.

Rossey, I., Gilman, M.S., Kabeche, S.C., Sedeyn, K., Wrapp, D., Kanekiyo, M., Chen, M., Mas, V., Spitaels, J., Melero, J.A., et al. (2017). Potent single-domain antibodies that arrest respiratory syncytial virus fusion protein in its prefusion state. Nat Commun 8, 14158.

Sande, C.J., Cane, P.A., and Nokes, D.J. (2014). The association between age and the development of respiratory syncytial virus neutralising antibody responses following natural infection in infants. Vaccine 32, 4726-4729.

Saravia, J., You, D., Shrestha, B., Jaligama, S., Siefker, D., Lee, G.I., Harding, J.N., Jones, T.L., Rovnaghi, C., Bagga, B., et al. (2015). Respiratory Syncytial Virus Disease Is Mediated by Age-Variable IL-33. PLoS Pathog 11, e1005217.

Sastre, P., Melero, J.A., Garcia-Barreno, B., and Palomo, C. (2005). Comparison of affinity chromatography and adsorption to vaccinia virus recombinant infected cells for depletion of antibodies directed against respiratory syncytial virus glycoproteins present in a human immunoglobulin preparation. J Med Virol 76, 248-255.

Sather, D.N., Armann, J., Ching, L.K., Mavrantoni, A., Sellhorn, G., Caldwell, Z., Yu, X., Wood, B., Self, S., Kalams, S., et al. (2009). Factors associated with the development of cross-reactive neutralizing antibodies during human immunodeficiency virus type 1 infection. J Virol 83, 757-769.

Shi, T., McAllister, D.A., O'Brien, K.L., Simoes, E.A.F., Madhi, S.A., Gessner, B.D., Polack, F.P., Balsells, E., Acacio, S., Aguayo, C., et al. (2017). Global, regional, and national disease burden estimates of acute lower respiratory infections due to respiratory syncytial virus in young children in 2015: a systematic review and modelling study. Lancet.

Shinoff, J.J., O'Brien, K.L., Thumar, B., Shaw, J.B., Reid, R., Hua, W., Santosham, M., and Karron, R.A. (2008). Young infants can develop protective levels of neutralizing antibody after infection with respiratory syncytial virus. J Infect Dis 198, 1007-1015.

(56) References Cited

OTHER PUBLICATIONS

Siegrist, C.A., and Aspinall, R. (2009). B-cell responses to vaccination at the extremes of age. Nat Rev Immunol 9, 185-194.
Simek, M.D., Rida, W., Priddy, F.H., Pung, P., Carrow, E., Laufer, D.S., Lehrman, J.K., Boaz, M., Tarragona-Fiol, T., Miiro, G., et al. (2009). Human immunodeficiency virus type 1 elite neutralizers: individuals with broad and potent neutralizing activity identified by using a high-throughput neutralization assay together with an analytical selection algorithm. J Virol 83, 7337-7348.
Sok, D., Briney, B., Jardine, J.G., Kulp, D.W., Menis, S., Pauthner, M., Wood, A., Lee, E.C., Le, K.M., Jones, M., et al. (2016). Priming HIV-1 broadly neutralizing antibody precursors in human Ig loci transgenic mice. Science 353, 1557-1560.
Sui, J., Hwang, W.C., Perez, S., Wei, G., Aird, D., Chen, L.M., Santelli, E., Stec, B., Cadwell, G., Ali, M., et al. (2009). Structural and functional bases for broad-spectrum neutralization of avian and human influenza A viruses. Nat Struct Mol Biol 16, 265-273.
Swanson, K.A., Settembre, E.C., Shaw, C.A., Dey, A.K., Rappuoli, R., Mandl, C.W., Dormitzer, P.R., and Carfi, A. (2011). Structural basis for immunization with postfusion respiratory syncytial virus fusion F glycoprotein (RSV F) to elicit high neutralizing antibody titers. Proc Natl Acad Sci U S A 108, 9619-9624.
Swers, J.S., Kellogg, B.A., and Wittrup, K.D. (2004). Shuffled antibody libraries created by in vivo homologous recombination and yeast surface display. Nucleic Acids Res 32, e36.
Thomson, C.A., Bryson, S., McLean, G.R., Creagh, A.L., Pai, E.F., and Schrader, J.W. (2008). Germline V-genes sculpt the binding site of a family of antibodies neutralizing human cytomegalovirus. EMBO J 27, 2592-2602.
Throsby, M., van den Brink, E., Jongeneelen, M., Poon, L.L., Alard, P., Cornelissen, L., Bakker, A., Cox, F., van Deventer, E., Guan, Y., et al. (2008). Heterosubtypic neutralizing monoclonal antibodies cross-protective against H5N1 and H1N1 recovered from human IgM+ memory B cells. PLoS One 3, e3942.
Tiller, T., Meffre, E., Yurasov, S., Tsuiji, M., Nussenzweig, M.C., and Wardemann, H. (2008) Efficient generation of monoclonal antibodies from single human B cells by single cell RT-PCR and expression vector cloning. J Immunol Methods 329, 112-124.
Trang, N.V., Braeckman, T., Lernout, T., Hau, V.T., Anh Ie, T.K., Luan Ie, T., Van Damme, P., and Anh, D.D. (2014). Prevalence of rotavirus antibodies in breast milk and inhibitory effects to rotavirus vaccines. Hum Vaccin Immunother 10, 3681-3687.
Troisi, C.L., Hollinger, F.B., Krause, D.S., and Pickering, L.K. (1997). Immunization of seronegative infants with hepatitis A vaccine (HAVRIX; SKB): a comparative study of two dosing schedules. Vaccine 15, 1613-1617.
Wang, J., He, Y., Jin, D., Liu, J., Zheng, J., Yuan, N., Bai, Y., Yan, T., Yang, Y., Liu, Y., et al. (2017). No response to hepatitis B vaccine in infants born to HBsAg(+) mothers is associated to the transplacental transfer of HBsAg. Infect Dis (Lond), 1-8.
Wen, X., Mousa, J.J., Bates, J.T., Lamb, R.A., Crowe, J.E., Jr., and Jardetzky, T.S. (2017). Structural basis for antibody cross-neutralization of respiratory syncytial virus and human metapneumovirus. Nat Microbiol 2, 16272.
Williams, J.V., Weitkamp, J.H., Blum, D.L., LaFleur, B.J., and Crowe, J.E., Jr. (2009). The human neonatal B cell response to respiratory syncytial virus uses a biased antibody variable gene repertoire that lacks somatic mutations. Mol Immunol 47, 407-414.
Wu, S.J., Schmidt, A., Beil, E.J., Day, N.D., Branigan, P.J., Liu, C., Gutshall, L.L., Palomo, C., Furze, J., Taylor, G., et al. (2007). Characterization of the epitope for anti-human respiratory syncytial virus F protein monoclonal antibody 101F using synthetic peptides and genetic approaches. J Gen Virol 88, 2719-2723.
Xu, Y., Roach, W., Sun, T., Jain, T., Prinz, B., Yu, T.Y., Torrey, J., Thomas, J., Bobrowicz, P., Vasquez, M., et al. (2013). Addressing polyspecificity of antibodies selected from an in vitro yeast presentation system: a FACS-based, high-throughput selection and analytical tool. Protein Eng Des Sel 26, 663-670.
Yacoob, C., Pancera, M., Vigdorovich, V., Oliver, B.G., Glenn, J.A., Feng, J., Sather, D.N., McGuire, A.T., and Stamatatos, L. (2016). Differences in Allelic Frequency and CDRH3 Region Limit the Engagement of HIV Env Immunogens by Putative VRC01 Neutralizing Antibody Precursors. Cell Rep 17, 1560-1570.
Yeung, Y.A., Foletti, D., Deng, X., Abdiche, Y., Strop, P., Glanville, J., Pitts, S., Lindquist, K., Sundar, P.D., Sirota, M., et al. (2016). Germline-encoded neutralization of a *Staphylococcus aureus* virulence factor by the human antibody repertoire. Nat Commun 7, 13376.
Zhang, X., Zhivaki, D., and Lo-Man, R. (2017). Unique aspects of the perinatal immune system. Nat Rev Immunol.
Zhu, Q., McLellan, J.S., Kallewaard, N.L., Ulbrandt, N.D., Palaszynski, S., Zhang, J., Moldt, B., Khan, A., Svabek, C., McAuliffe, J.M., et al. (2017). A highly potent extended half-life antibody as a potential RSV vaccine surrogate for all infants. Sci Transl Med 9.
Glezen, W. P. et al., Risk of primary infection and reinfection with respiratory syncytial virus, Am J Dis Child, 140:543-546 (1986).
Graham, B.S., Vaccine development for respiratory syncytial virus, Curr Opin Virol, 23:107-112 (2017).

* cited by examiner

Fig. 7A
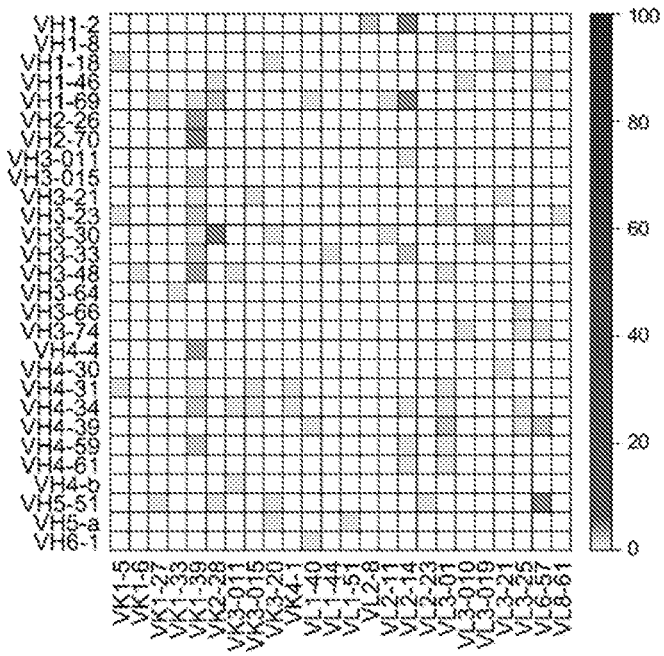
Fig 7B
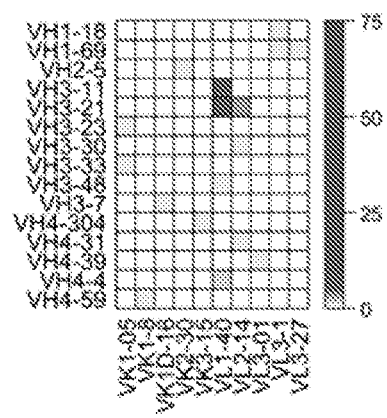
Fig. 7C
Fig. 7D
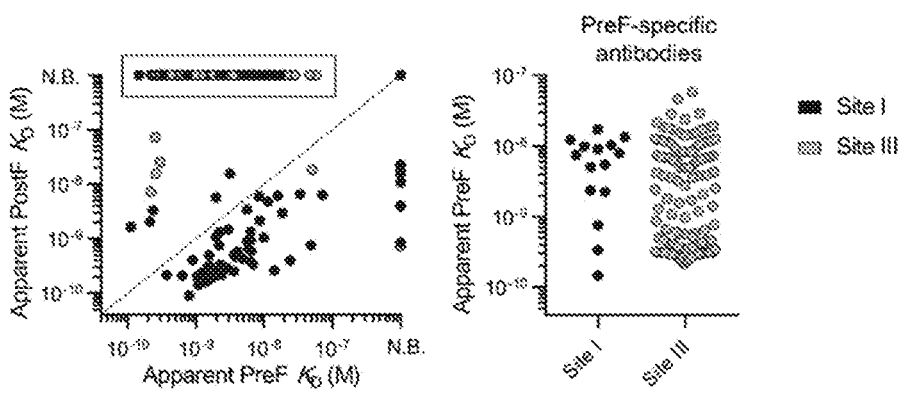
Fig. 7E
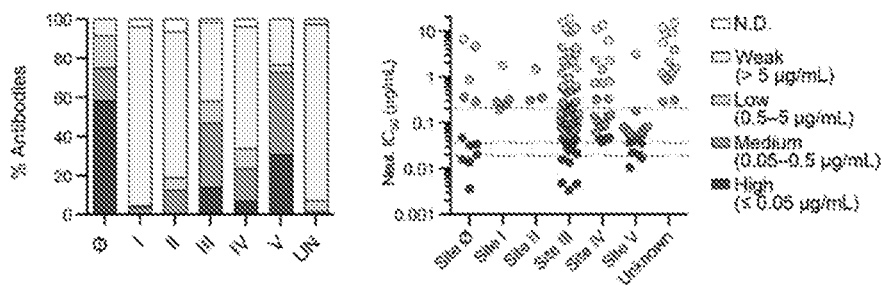

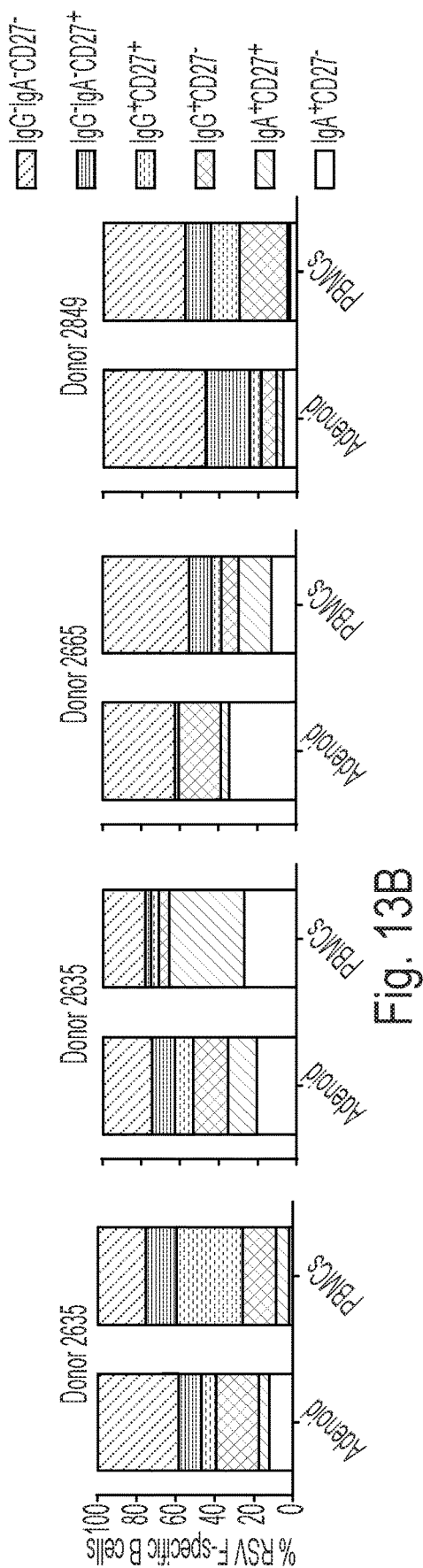
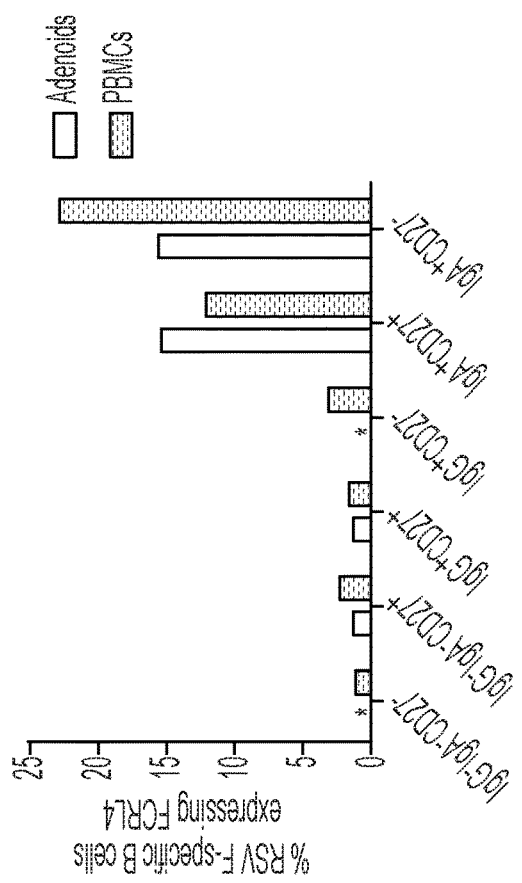
Fig. 13B
Fig. 13C ial Virus
ANTI-RESPIRATORY SYNCYTIAL VIRUS ANTIBODIES, METHODS OF THEIR GENERATION AND USE

CROSS REFERENCE TO RELATED APPLICATIONS

This application is a national stage filing under 35 U.S.C. § 371 of International PCT Application No. PCT/US2018/055750 filed Oct. 12, 2018, which claims the benefit of U.S. Provisional Application No. 62/572,400 filed Oct. 13, 2017, the contents of all of which are herein incorporated by reference in their entirety.

SEQUENCE LISTING

This application contains a Sequence Listing filed herewith in ASCII format named 2009186_0296_SL.txt, created on Aug. 18, 2021 and 2,383,864 bytes in size. The Sequence Listing is incorporated by reference herein.

FIELD OF THE INVENTION

The invention is related to human antibodies and antigen-binding fragments thereof that specifically bind to Respiratory Syncytial Virus fusion glycoprotein (RSV F) ("anti-RSV F antibodies"), in particular infant anti-RSV F antibodies, compositions comprising these antibodies, and methods for the preparation and use of these antibodies.

BACKGROUND OF THE INVENTION

Respiratory syncytial virus (RSV) is a ubiquitous pathogen that causes bronchiolitis and pneumonia in infants and the elderly and substantial morbidity and mortality in infants, the elderly, and immunocompromised individuals. Recent estimates indicate that RSV causes nearly 60,000 deaths annually in children under the age of five (Shi et al., 2017). Currently, the only preventive measure available for RSV is passive prophylaxis with the monoclonal antibody Synagis® (Group, 1998). Unfortunately, prophylaxis with Synagis® is costly, requires multiple doses per RSV season, and is only modestly efficacious (Group, 1998; Homaira et al., 2014; Kamal-Bahl et al., 2002). These factors restrict its use to high-risk infants and limit its availability in developing countries where the greatest burden of RSV-associated mortality exists. Therefore, the development of an effective RSV vaccine and next-generation monoclonal antibodies is of great importance and ongoing clinical trials are evaluating numerous candidates (Griffin et al., 2017; PATH, 2017; Reichert, 2016; Zhu et al., 2017).

The development of an RSV vaccine has proven to be particularly challenging, due in part to the young age at which primary infection occurs (Glezen et al., 1986), a history of vaccine-enhanced disease in infants (Chin et al., 1969; Fulginiti et al., 1969; Kapikian et al., 1969; Kim et al., 1969), and a lack of long-lived immunity in response to natural infection, resulting in frequent reinfections (Hall et al., 1991; Henderson et al., 1979). Although there are no clinically approved RSV vaccines, there are 43 vaccine candidates in development, of which 19 are in clinical stage development (Center for Vaccine Innovation and Access, PATH available on the world wide web at path.org/programs/center-for-vaccine-innovation-and-access/). Most of these vaccines seek to induce neutralizing antibodies that recognize the RSV fusion (F) glycoprotein, which is targeted by the prophylactic antibody palivizumab and the majority of RSV-specific neutralizing antibodies in human sera.

The goal of most vaccination efforts against RSV is not to prevent infection, but to reduce the risk of RSV-related complications in high-risk populations, such as infants and the elderly. Five target age groups for vaccination have been proposed—infants under six months of age, infants over six months of age, school-aged children, pregnant women, and adults over 65 years old—with the goal of either directly or indirectly protecting at-risk populations (Anderson et al., 2013). These target age groups have different immunological characteristics that may require different vaccination strategies for optimal protection. Although multiple modalities for an RSV vaccine are currently being pursued, most vaccination strategies share a common goal: to elicit neutralizing antibodies that recognize the RSV fusion glycoprotein (RSV F), which is targeted by the majority of RSV-neutralizing activity in human sera (Magro et al., 2012; Sastre et al., 2005).

RSV F is a class I fusion protein that mediates viral entry into host cells by converting from a metastable prefusion conformation (preF) to a highly stable postfusion (postF) conformation. On the surface of the virus, RSV F exists in a metastable trimeric prefusion conformation (preF) before undergoing a dramatic structural rearrangement that results in the insertion of a hydrophobic fusion peptide into the host-cell membrane. This intermediate state of RSV F tethers the viral and host-cell membranes before collapsing to form the stable six-helix bundle that is characteristic of the postfusion conformation (postF). Fusion of the viral and host-cell membranes is driven by these conformational changes, and the antigenic topology of RSV F is substantially altered during this transition. Over the past several years, epitope mapping studies using both human and murine monoclonal antibodies have defined at least 6 major antigenic sites on the RSV F protein. Some groups of epitopes, referred to as antigenic sites, are generally conserved on both the preF and postF, whereas others antigenic sites are preferentially or exclusively expressed on only one conformation (Graham, 2017; McLellan et al., 2013; McLellan et al., 2011; Swanson et al., 2011). Molecules that prevent these structural changes can prevent viral fusion and have potential as therapeutics for RSV (Battles et al., 2016; Huang et al., 2010; Lambert et al., 1996; McLellan et al., 2013). Recent studies have shown that the vast majority of highly potent neutralizing antibodies target epitopes that are exclusively expressed on preF. Hence, vaccines that specifically induce preF-specific antibodies may have great clinical potential.

The first characterized RSV F-reactive antibodies bound to structural elements shared by both preF and postF and were F-conformation-independent. These include Synagis®, which recognizes a helix-turn-helix motif called antigenic site II (Beeler and van Wyke Coelingh, 1989; McLellan et al., 2010b), and 101F, which recognizes the β-strand-rich antigenic site IV (McLellan et al., 2010a; Wu et al., 2007). Antibodies that preferentially bind to postF at antigenic site I were also among the first to be isolated, but were only weakly neutralizing (Anderson et al., 1986; Garcia-Barreno et al., 1989). The first preF-specific antibodies to be described recognized antigenic site Ø, present at the apex of the preF trimer, and were shown to be extremely potent (McLellan et al., 2013). A second class of potently neutralizing antibodies, epitomized by MPE8, was later described and shown to recognize antigenic site III (Corti et al., 2013). Although the secondary structure elements that form site III are present on both preF and postF, they adopt a different spatial arrangement in postF that dramatically decreases the affinity of site III-directed antibodies for this conformation and results in preferential binding to preF (Corti et al., 2013; Rossey et al., 2017; Wen et al., 2017). Antigenic site V, located between sites Ø and III, was recently identified and shown to be the target of additional preF-specific antibodies that are also potently neutralizing (Gilman et al., 2016; Mousa et al., 2017). The isolation and characterization of preF-specific antibodies spurred the development of second-generation prophylactics, such as MEDI8897, which recognizes site Ø (Griffin et al., 2017; Zhu et al., 2017) and is currently in late-phase clinical trials as a potential replacement for Synagis®.

An effective RSV vaccine will likely require the elicitation of potent neutralizing antibodies and balanced cellular responses (Kristjansson et al., 2005; Lambert et al., 2014; Legg et al., 2003; Saravia et al., 2015; Zhang et al., 2017). Infants present a number of unique challenges for vaccine development, including suppression of B cell responses by maternally derived antibody (Gans et al., 2001; Sande et al., 2014; Trang et al., 2014; Troisi et al., 1997; Wang et al., 2017) and immunological immaturity that results in reduced levels of T cell help, antibody class-switching, and somatic hypermutation (SHM) (Siegrist and Aspinall, 2009). Studies of convalescent infant sera have demonstrated that infants generally produce low titers of RSV-neutralizing antibodies after natural infection (Esposito et al., 2016; Murphy et al., 1986; Sande et al., 2014) but that these titers are higher when levels of maternal antibody are low (Shinoff et al., 2008), suggesting that infants are capable of mounting neutralizing antibody responses to RSV under certain circumstances. Serum studies have also suggested that different epitopes may be targeted as children age into adulthood (Fuentes et al., 2016), but little is known about how these changes are associated with antibody sequence or neutralization potency. In addition, sequencing studies have demonstrated that the antibody variable genes cloned from RSV-specific B cells in infants under three months of age contain little to no SHM, but the corresponding antibodies were not produced and characterized (Williams et al., 2009).

RSV replicates exclusively in respiratory epithelial cells, initiating infection in the upper respiratory tract and in some cases progressing to the lower respiratory tract. Therefore, an effective RSV vaccine may induce systemic and mucosal immune responses that protect both the upper and lower respiratory tracts (Varga, Current Opinion in Virology, 2014). A substantial body of literature suggests that RSV-specific mucosal antibody levels correlate more strongly with protection against RSV infection than serum antibody titers (Mills J T J Immnology 1971; Singleton R et al, JVI, 2003; walsh EE et al, JID, 2004; Habibi, AJRCCM 2015; Bagga JID, 2015; Vissers, CVI 2016; Watt P J Vaccine 1990). For example, experimental RSV challenge studies in adult donors have shown that nasal antibody strongly predicts protection from RSV infection (Habibi, AJRCCM 2015). In addition, a recent study in a clinical pediatric cohort showed that high levels of RSV-specific mucosal IgG correlated with reduced viral load and inflammation, whereas plasma IgG levels were not predictive of either (Vissers, CVI 2016). Finally, preclinical immunogenicity and efficacy studies utilizing a live-attenuated vaccine candidate, RGΔM2-2, showed that the protective efficacy of this vaccine was significantly higher when delivered by the intrasanal route compared to the intramuscular route, despite both vaccines inducing comparable serum antibody titers. These studies provide compelling evidence that mucosal immunity may be required for efficient protection against RSV. However, relatively little is known about the anatomic location(s) of RSV-specific memory B cells within mucosa-associated lymphoid tissues, the specificities and functional properties of these antibodies, and if/how the RSV-specific mucosal antibody response differs from the systemic antibody response. A better understanding of these aspects of RSV infection and immune responses may provide useful information for the development of effective RSV vaccines.

SUMMARY OF THE INVENTION

An improved understanding of the specificities and functional activities of antibodies induced by natural RSV infection in young infants could facilitate the design of vaccine antigens that are less susceptible to interference by maternal antibodies and that focus the response on epitopes associated with neutralizing activity. RSV is a leading cause of infant mortality, and there are currently no licensed vaccines to protect this vulnerable population. A comprehensive understanding of infant antibody responses to natural RSV infection will facilitate vaccine development.

Applicant has discovered, isolated, and characterized an extensive panel of RSV F-specific monoclonal antibodies from several RSV-infected infants, some of which antibodies recognize antigenic sites distinct from those sites that dominate adult responses. In particular, over 450 RSV F-specific antibodies from the peripheral B cells of seven RSV-infected infants were isolated and characterized and, additionally, over 800 RSV F-specific antibodies from paired peripheral blood and adenoid tissues of 6 young children were isolated and characterized.

Binding and functional studies of the isolated anti-RSV F infant antibodies generally demonstrate binding to 2 primary antigenic sites and different neutralization potentials, i.e., non-neutralizing antibodies that bind to site I on postfusion F and neutralizing antibodies that bind to site III or site V on postfusion F. Structural studies provide a molecular basis for the conserved features of antibodies recognizing these sites. A subset of antibodies targeting one of the sites displayed potent neutralizing activity despite lacking somatic mutations, suggesting such antibodies can be induced in young infants with suitably designed vaccine antigens. Accordingly, Applicant provides fundamental insights into infant antibody responses in different immune compartments (e.g., mucosal and systemic) and, thus, provides a blueprint for the rational design of infant vaccine immunogens that selectively elicit desired B cell responses in infants.

In some embodiments, the present disclosure provides isolated antibodies or antigen-binding polypeptides comprising a VH CDR3 having an amino acid sequence according to an antibody number in Table 9B.

In some embodiments, the present disclosure provides isolated antibodies or antigen-binding polypeptides comprising a VH CDR3 having an amino acid sequence according to an ADI listed in Table 8.

In some embodiments, the present disclosure provides isolated antibodies or antigen binding polypeptides characterized by ability to neutralize respiratory syncytial virus (RSV).

In some embodiments, antibodies or antigen binding polypeptides are characterized by high affinity binding to RSV F.

In some embodiments, antibodies or antigen binding polypeptides are characterized by high affinity binding to RSV prefusion F (preF).

In some embodiments, isolated antibodies have an amino acid sequence according to:

(i) Antibody Number 2, 71, 112, 217, 227, 228, 249, 466, 467, 469, 470, 832, 471, 516, 527, 532, 543, 544, 551, 554, 571, 578, 581, 592, 615, 641, 843, 868, or 870;

(ii) an Antibody Number of (i) with no more than 3 amino acid substitutions, additions, or deletions;

(iii) an Antibody Number of (i) with no more than 3, 2, or 1 amino acid substitution(s), addition(s), or deletion(s) in a CDR; or (iv) an Antibody Number of (i) with no more than 3, 2, or 1 amino acid substitution(s), addition(s), or deletion(s) in CDRH3.

In some embodiments, antibodies or antigen-binding polypeptides have an IC50 of less than 300 pM, less than 200 pM, or less than 100 pM for neutralization of RSV.

In some embodiments, antibodies or antigen-binding polypeptides are characterized by binding affinity to pre-F with a kD of less than 10 nM.

In some embodiments, antibodies or antigen-binding polypeptides characterized by a binding affinity to pre-F that is at least 10, 100, or 1000 fold greater than binding affinity to post-F.

In some embodiments, antibodies or antigen-binding polypeptides are characterized by high affinity binding to RSV F site III.

In some embodiments, the present disclosure provides an antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRH3 amino acid sequence that is at least 80%, 85%, 90%, 95%, 96%, 97%, 98%, or 99% identical to a CDRH3 amino acid sequence of an antibody selected from Antibody Number 1 through Antibody Number 947 as disclosed in Table 5.

The present disclosure also provides an antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRH2 amino acid sequence that is at least 80%, 85%, 90%, 95%, 96%, 97%, 98%, or 99% identical to a CDRH2 amino acid sequence of an antibody selected from Antibody Number 1 through Antibody Number 947 as disclosed in Table 5.

The present disclosure further provides an antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRH1 amino acid sequence that is at least 80%, 85%, 90%, 95%, 96%, 97%, 98%, or 99% identical to a CDRH1 amino acid sequence of an antibody selected from Antibody Number 1 through Antibody Number 947 as disclosed in Table 5.

The present disclosure also provides an antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRL3 amino acid sequence that is at least 80%, 85%, 90%, 95%, 96%, 97%, 98%, or 99% identical to a CDRL3 amino acid sequence of an antibody selected from Antibody Number 1 through Antibody Number 947 as disclosed in Table 5.

The present disclosure further provides an antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRL2 amino acid sequence that is at least 80%, 85%, 90%, 95%, 96%, 97%, 98%, or 99% identical to a CDRL2 amino acid sequence of an antibody selected from Antibody Number 1 through Antibody Number 947 as disclosed in Table 5.

The present disclosure also provides an antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRL1 amino acid sequence that is at least 80%, 85%, 90%, 95%, 96%, 97%, 98%, or 99% identical to a CDRL1 amino acid sequence of an antibody selected from Antibody Number 1 through Antibody Number 947 as disclosed in Table 5.

In some embodiments, the anti-RSV F antibody comprises (i) the CDRH3 amino acid sequence of an antibody selected from Antibody Number 1 through Antibody Number 947 as disclosed in Table 5; (ii) the CDRH2 amino acid sequence of an antibody selected from Antibody Number 1 through Antibody Number 947 as disclosed in Table 5; (iii) the CDRH1 amino acid sequence of an antibody selected from Antibody Number 1 through Antibody Number 947 as disclosed in Table 5; (iv) the CDRL3 amino acid sequence of an antibody selected from Antibody Number 1 through Antibody Number 947 as disclosed in Table 5; (v) the CDRL2 amino acid sequence of an antibody selected from Antibody Number 1 through Antibody Number 947 as disclosed in Table 5; (vi) the CDRL1 amino acid sequence of an antibody selected from Antibody Number 1 through Antibody Number 947 as disclosed in Table 5; or (vii) any combination of two or more of (i), (ii), (iii), (iv), (v), and (vi).

In other embodiments, the antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising (i) a heavy chain variable region (VH) that is at least 80%, 85%, 90%, 95%, 96%, 97%, 98%, or 99% identical to a $V_H$ amino acid sequence of an antibody selected from Antibody Number 1 through Antibody Number 947 as disclosed in Table 5, and/or (ii) a light chain variable region ($V_L$) that is at least 80%, 85%, 90%, 95%, 96%, 97%, 98%, or 99% identical to a $V_L$ amino acid sequence of an antibody selected from Antibody Number 1 through Antibody Number 947 as disclosed in Table 5.

In yet other embodiments, the anti-RSV F antibody comprises (i) the $V_H$ amino acid sequence of an antibody selected from Antibody Number 1 through Antibody Number 947 as disclosed in Table 5; and/or (ii) the $V_L$ amino acid sequence of an antibody selected from Antibody Number 1 through Antibody Number 947 as disclosed in Table 5.

In certain embodiments, the anti-RSV F antibody is selected from the group consisting of Antibody Number 1 through Antibody Number 947 as disclosed in Table 5.

In some embodiments, the anti-RSV F antibody binds to an epitope comprising site Ø, site I, site II, site III, site IV, or site V of RSV F. In one embodiment, the anti-RSV F antibody binds to an epitope on prefusion F (preF), preferably antigenic site III. In other embodiments, the anti-RSV F antibody binds to an epitope on postfusion F (post F), preferably antigenic site I.

In some embodiments, the anti-RSV F antibody binds to prefusion F (preF) with high affinity but does not bind to or binds with low affinity to postfusion F (postF).

In some embodiments, the anti-RSV F antibody does not compete with D25 for binding to RSV F. In some embodiments, the anti-RSV F antibody competes with MPE8 and/or motavizumab for binding to RSV F.

In some embodiments, the anti-RSV F antibody is a neutralizing antibody. In a certain embodiment, the anti-RSV F antibody has a neutralizing activity ($IC_{50}$) of less than 100 µg/ml, 50 µg/ml, 25 µg/ml, 10 µg/ml, 5 µg/ml, 1 µg/ml, 0.5 µg/ml, 0.1 µg/ml, or 0.05 µg/ml.

In some embodiments, the anti-RSV F antibody binds to RSV prefusion F with a $K_D$ value of less than 50 nM, 25 nM, 10 nM, 5 nM, 1 nM, 0.5 nM, or 0.1 nM as measured by surface plasmon resonance.

In some embodiments, the anti-RSV F antibody binds to RSV prefusion F through one or both of the following interactions: a) Tyr33 in CDRL1 and Tyr93 in CDRL3 both contact the α6-α7 loop of RSV prefusion F; and b) five consecutive serine residues, preferably followed by a tyrosine residue (Tyr56), in CDRH2 form a network of hydrogen bonds with Asp310 on β6 of RSV prefusion F.

In some embodiments, the anti-RSV F antibody has a clean or low polyreactivity profile.

In some embodiments, the anti-RSV F antibody is a full-length IgG1 monoclonal antibody.

In some embodiments, the anti-RSV F antibody is a human antibody.

In some embodiments, the anti-RSV F antibody comprises a Fc region that has been modified to alter effector function, half-life, proteolysis, and/or glycosylation.

In some embodiments, the anti-RSV F antibody is derivatized.

The present disclosure further encompasses a nucleic acid sequence or nucleic acid sequences encoding the anti-RSV F antibodies described herein; expression vectors comprising the isolated nucleic acid sequence(s); and host cell(s) comprising the isolated nucleic acid sequence(s) or the expression vector(s). In some embodiments, the host cell is a mammalian cell, a bacterial cell, a fungal cell, a yeast cell, or an insect cell.

Additionally, the present disclosure encompasses a method for producing an isolated human antibody or antigen-binding fragment thereof that specifically binds to Respiratory Syncytial Virus (RSV) fusion glycoprotein (F) ("an anti-RSV F antibody") comprising expressing the nucleic acid sequence(s) described herein or culturing the host cell(s) described herein (e.g., a yeast cell or a mammalian cell) under conditions that provide for expression of the anti-RSV F antibody and optionally recovering the anti-RSV F antibody from the host cell and/or culture medium.

The present disclosure also contemplates a pharmaceutical composition comprising (i) an anti-RSV F antibody(ies) described herein, the nucleic acid sequence(s) described herein, the expression vector(s) described herein, or the host cell(s) described herein; and (ii) a pharmaceutically acceptable carrier and/or excipient. The pharmaceutical composition can be used for preventing or treating a RSV infection in a subject. In one embodiment, the subject is a human, preferably an infant.

Furthermore, the present disclosure encompasses a method of preventing or treating a Respiratory Syncytial Virus (RSV) infection in a subject (e.g., a human or a non-human), comprising administering to the subject in need thereof an effective amount of the anti-RSV F antibody(ies) described herein, the isolated nucleic acid sequence(s) described herein, the expression vector(s) described herein, or the host cell(s) described herein, optionally in association with a further prophylactic and/or therapeutic agent. In one embodiment, the further prophylactic and/or therapeutic agent is selected from an antiviral agent; a vaccine specific for RSV; a vaccine specific for influenza virus; a vaccine specific for metapneumovirus (MPV); an siRNA specific for a RSV antigen; an siRNA specific for a MPV antigen; a second anti-RSV antibody; an anti-MPV antibody; an anti-IL4R antibody; an anti-influenza antibody; and a NSAID. In some embodiments, the subject is a human, preferably an infant.

Also provided herein is a method of preventing or treating a Respiratory Syncytial Virus (RSV) infection in a human subject (e.g., an infant) comprising administering to the subject in need thereof an effective amount of the pharmaceutical composition described herein.

Additionally provided herein is a method for detecting a Respiratory Syncytial Virus (RSV) infection in a subject (e.g., a human or a non-human) comprising obtaining a sample from the subject; contacting the sample with the anti-RSV F antibody(ies) described herein; and detecting the presence of a complex between the anti-RSV F antibody and the RSV fusion glycoprotein (F), wherein detection of the complex indicates the presence of RSV. In one embodiment, the subject is a human subject, preferably an infant.

Other features and advantages of the instant invention will be apparent from the following detailed description and examples which should not be construed as limiting. The contents of all cited references, including scientific articles, patents and patent applications cited throughout this application, are expressly incorporated herein by reference.

BRIEF DESCRIPTION OF THE FIGURES

FIG. 1A shows the gating strategy for a representative infant ≥6 months (Infant 2042), and FIG. 1B shows the gating strategy for a representative infant <3 months (Infant 2026). Lymphocytes were gated based on forward and side scatter, followed by a live/dead gate and selection of $CD3^-$ $CD8^-$ $^{CD}14^-$ cells. B cells were identified by gating on $CD19^+/CD20^+$ cells. $IgG^+$ or $IgA^+$ B cells or $CD19/CD20^+$ B cells that showed reactivity with RSV F were single-cell sorted for antibody cloning. B cell reactivity with subtype A and subtype B is shown in the top and middle rows, respectively. The index sorting analysis is shown in the bottom panel. SSC-A, side scatter area; FSC-A, forward scatter area. FIG. 1C shows the percentage of RSV F-specific, class-switched B cells for each infant (FIG. 1C). Values were calculated based on flow cytometry data.

FIG. 2C shows the results of index sort analysis of the surface markers expressed on B cells from which RSV F-reactive antibodies were isolated. FIG. 2D shows the number of $V_H$ nucleotide substitutions for antibodies isolated from RSV F-specific class-switched B cells (the red bars indicate medians). In both FIG. 2C and FIG. 2D, infants are ordered from youngest to oldest, left to right. FIG. 2E shows a heat map of $V_H$ and $V_L$ germline gene usage for all infants (left panel), showing only genes for which at least one $V_H/V_L$ pairing was utilized in ≥0.5% of all antibodies isolated. The percent total of antibodies with the designated $V_H/V_L$ pairing is provided (right panel).

FIG. 3D shows the apparent affinities for postF plotted against apparent affinities for preF for infants <3 months (left panel) and ≥6 months (right panel).

In FIGS. 4B and 4C, antibodies for which preF and postF binding affinities were measured are grouped according to preF or postF specificity.

FIG. 6A shows the preF structure with two protomers as grey molecular surfaces and one protomer as ribbons colored according to the antigenic site. FIG. 6B shows the percentage of isolated antibodies that recognize each antigenic site, plotted for each donor. Infants are ordered from youngest to oldest, left to right. FIG. 6C shows antibodies isolated from infants <3 months (left panel) and ≥6 months (right panel) grouped according to neutralization potency and antigenic site. N.N., non-neutralizing.

FIGS. 7A-7E show antibodies directed towards sites I and III utilize convergent sequence features and preferentially bind to different conformations of RSV F. Heat map of VH and VL germline gene usage for all site I-directed antibodies for which at least one VH/VL pairing was used in ≥0.5% of the antibodies directed against site I (FIG. 7A). A heat map of VH and VL germline gene usage for all site III-directed antibodies for which at least one VH/VL pairing was used in ≥0.5% of the antibodies directed against site III (FIG. 7B). WebLogos showing the CDR H3 sequence motifs for site I-directed (top) and site III-directed (bottom) antibodies (FIG. 7C). Apparent binding affinities for postF are plotted against apparent affinities for preF for antibodies directed against site I and site III (FIG. 7D, left panel). Antibodies that are preF-specific are boxed in. Apparent preF affinity for preF-specific antibodies is shown (FIG. 7D, right panel). Antibodies are grouped according to antigenic site and the percentage of antibodies in each group with high, medium, low, or weak neutralization potency is shown (FIG. 7E, left panel). Neutralization $IC_{50}$s is plotted for the antibodies in each group with detectable neutralization activity (FIG. 7E, right panel). Top, middle, and bottom dotted lines show $IC_{50}$s for motavizumab, MPE8 and D25, respectively.

FIG. 8A shows the neutralization potency ($IC_{50}$) of antibodies lacking VH or VL nucleotide substitutions, grouped according to antigenic site. Top, middle, and bottom dotted lines show the $IC_{50}$ value for motavizumab, MPE8, and D25, respectively. N.N., non-neutralizing. No antibodies against site Ø lacking substitutions were obtained. FIG. 8B shows the results of index sort analysis of the surface markers expressed on cells from which RSV-reactive antibodies were isolated in infants <3 months. The percentage of B cells in each group is shown for all antibodies, neutralizing antibodies that lack somatic mutations (germline neut.), and neutralizing antibodies that contain somatic mutations (mutated neut.). FIG. 8C contains pie charts showing the fraction of RSV F-reactive naïve B cells isolated from the cord blood of four donors (top panel) and peripheral blood from two donors (bottom panel) that utilized VH3-21/VL1-40 or VH3-11/VL1-40 germline gene pairing. Naïve B cells were defined as CD3 CD14 CD19$^+$ CD20$^+$ IgM$^+$ IgG$^-$ CD27$^-$ cells. The number in the center of the pie (top and bottom) indicates the total number of antibodies with detectible binding to RSV F when produced as full-length IgG. FIG. 8D shows the apparent affinity for preF for each of these antibodies and colored according to germline usage. Black bars indicate medians. $IC_{50}$ values for antibodies that displayed detectible neutralizing activity.

FIGS. 9A-9D shows the non-neutralizing antibody ADI-14359 uses a convergent CDR H3 motif and germline features of the VK1-39 light chain for binding to antigenic site Ion postF. FIG. 9A shows a crystal structure of infant antibody ADI-14359 (VH2-70/VK1-39) in complex with postF. FIG. 9B shows a magnified view of the CDRH3 of ADI-14359 inserted into a groove on the surface of postF. The variable region of ADI-14359 and one RSV F protomer are shown as ribbons and the C-α atom of Pro389, a residue associated with viral escape from site I-directed antibodies, is shown as a sphere. FIG. 9C shows a magnified view of the antibody interface, highlighting the features of the convergent CDR H3 motif that mediate recognition of site I (left panel), whereas a 180° rotation highlights the CDR H2 contacts made with postF (right panel). The sequence logo for the convergent CDR H3 motif is shown (generated using WebLogo, described by Crooks et al., 2004). FIG. 9D shows the binding of ADI-14359 to postF as measured by surface plasmon resonance (top panel). Rate constants for the germline-reverted variant (R50L) binding to postF were too fast to be accurately determined (top middle panel) and, therefore, the equilibrium responses were plotted against the concentration of Fab and fit to a steady-state affinity model (bottom middle panel). Binding of ADI-14359 to the K390A variant of postF was too weak to determine an affinity (bottom panel).

FIG. 11A shows a crystal structure of ADI-19425 in complex with preF viewed along (left panel) and above (right panel) the viral membrane. FIG. 11B shows a magnified view of the interface with the variable region of ADI-19425 and one RSV F protomer shown in ribbon (left panel) and a 90-degree rotation showing the interactions between the light chain of ADI-19425 and the α6-α7 loop of antigenic site II (right panel). FIG. 11C shows the binding of ADI-19425 and the Y33A, Y93A and Y56A variants to preF as measured by surface plasmon resonance.

FIGS. 13A-C show analysis of RSV F-specific B cell responses in the adenoids and peripheral blood of young children. RSV F-specific B cells were measured in adenoid and peripheral blood by flow cytometry (FIG. 13A, left, middle, and right panels). The left panel shows the frequency of RSV F-specific B cells among CD19$^+$ B cells in adenoid for a representative donor. The middle panel shows the frequency of RSV F-specific B cells among CD19$^+$ B cells in PBMCs for a representative donor. The frequency of RSV F-reactive B cells within the CD14$^-$CD3$^-$CD8$^-$ CD19$^+$ CD20$^+$ population is shown next to the gate. The right panel shows a summary for all 6 donors analyzed. Index sort analysis of surface markers expressed on B cells from which RSV F-reactive antibodies were isolated (FIG. 13B). Percentage of RSV F-reactive B cells within each memory B cell subset that express FCRL4 (FIG. 13C). Asterisks indicate B cell responses that were below the limit of detection.

FIG. 14A shows the percentage of RSV F-specific B cells among CD19$^+$ B cells in the adenoids and PBMCs for a representative donor. FIG. 14B shows the percentage of RSV F-specific B cells among CD19$^+$ B cells in the adenoids (left panel) and in the PBMCs (right panel) for a representative donor.

FIG. 15A shows that the RSV F-specific antibody repertoires were highly diverse in both compartments (adenoids and PBMCs) in all donors, each containing few to no expanded clonal lineages. FIG. 15B shows the CDRH3 length distribution of the antibodies isolated from PBMCs and adenoids. FIG. 15C shows a comparable VH germline gene usage between the two compartments, though there was an enrichment for VH5-51 and VH1-69 in the adenoid-derived antibodies and an enrichment for VH4-34 and VH3-30 in the PBMC-derived antibodies.

FIG. 16A shows the median number of VH nucleotide substitutions ranged from 8-11 in the adenoid-derived antibodies and 7-9 in the PBMC-derived antibodies. **** indicates that the difference in number of substitutions in the adenoid-derived antibodies relative to the PBMC-derived antibodies reached statistical significance in Donor 2665. FIG. 16B compares the levels of SHM within each individual B cell subset in adenoids (left panel) and PBMCs (right panel). FIG. 16C shows the percentage of antibodies derived from IgG-IgA-CD27-peripheral blood B cells containing SHM. FIG. 16D shows a subset of somatically mutated antibodies derived from IgG-IgA-CD27-peripheral blood B cells that contained lower levels of SHM compared to antibodies derived from IgG-IgA-CD27-adenoid B cells. FIG. 16E shows the IgM and IgD expression profiles of RSV F-specific IgG-IgA-CD27-adenoid B cells.

FIG. 17A shows the number of VH nucleotide substitutions for Donor 2635. FIG. 17B shows the number of VH nucleotide substitutions for Donor 2665. **** indicates that the difference in number of substitutions in the adenoid-derived antibodies relative to the PBMC-derived antibodies reached statistical significance in Donor 2665. FIG. 17C shows the number of VH nucleotide substitutions for Donor 2666. FIG. 17D shows the number of VH nucleotide substitutions for Donor 2849.

FIG. 18A shows the percentage of antibodies that bind RSV preF, postF, and preF & postF using biolayer interferometry. FIG. 18B shows the percentage of antibodies that bind preF with weak (>50 nm), low (>5 to 50 nM), medium (>0.5 to 5 nM), and high (<0.5 nM) binding affinities.

FIG. 19A shows the amount of detectable neutralizing activity (IC50<25 µg/mL) for adenoid and PBMC-derived antibodies using a luciferase-based assay. FIG. 19B shows the neutralization acitvy of preF-specific antibodies, postF-specific antibodies, and preF and PostF reactive antibodies isolated from both adenoids and PBMCs. FIG. 19C shows the memory B cell subsets for the adenoid-derived and PBMC-derived neutralizing antibodies. FIG. 19D shows the apparent preF $K_D$ (left panel) and the virus neutralization IC50 for each memory B cell subset.

FIG. 20A shows the percentage of antibodies having low and high levels of polyreactivity. FIG. 20B shows the percentage of low and high polyreactive clones across different B cell subsets within each compartment (left panel shows adenoid-derived antibodies and right panel shows PBMC-derived antibodies). FIG. 20C shows the percentage of antibodies having no binding or low, medium, or high affinity to RSV F.

DETAILED DESCRIPTION OF THE INVENTION

Figure 1A:
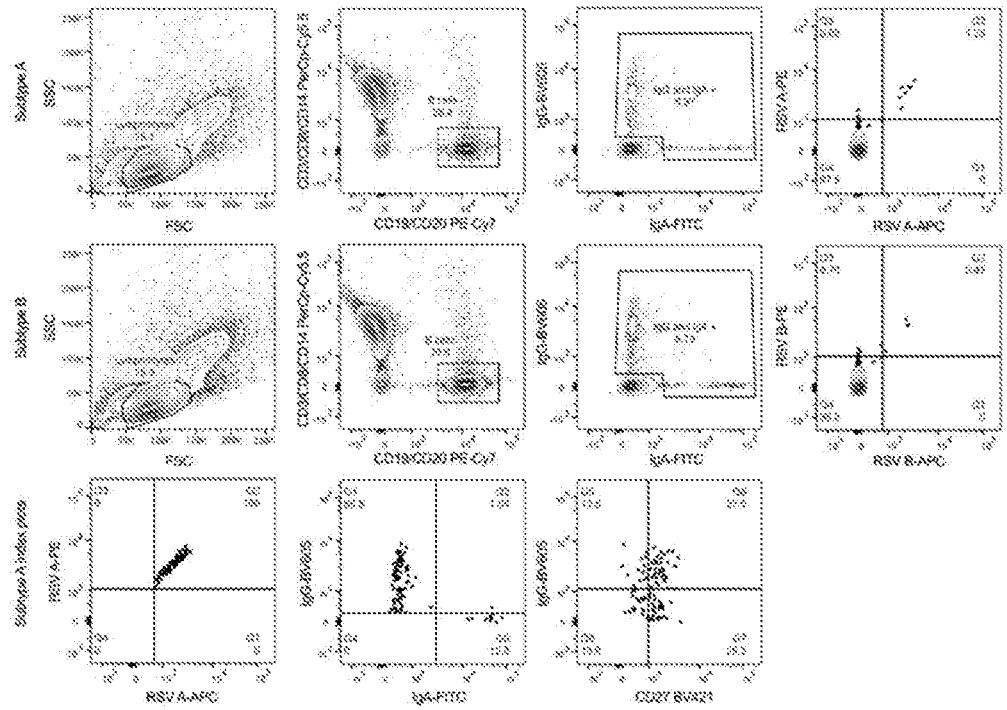
FIGS. 1A-1C show the single B cell sorting strategy.

The present disclosure relates anti-RSV F infant antibodies, compositions comprising such antibodies, and methods for obtaining and using such antibodies. In some embodiments, the antibodies are neutralizing antibodies and, thus, the anti-RSV F neutralizing antibodies and compositions comprising such antibodies can be used as a vaccine. For infants, in particular, the subject anti-RSV F antibodies may provide advantageous protection.

Definitions

In order that the present disclosure may be more readily understood, certain terms are first defined. As used in this application, except as otherwise expressly provided herein, each of the following terms shall have the meaning set forth below. Additional definitions are set forth throughout the application. Unless defined otherwise, all technical and scientific terms used herein have the same meaning as commonly understood by one of ordinary skill in the art to which this invention belongs.

As used herein, the term "about," when used in reference to a particular recited numerical value, means that the value may vary from the recited value by no more than 1%. For example, as used herein, the expression "about 100" includes 99 and 101 and all values in between (e.g., 99.1, 99.2, 99.3, 99.4, etc.).

"Respiratory Syncytial Virus fusion glycoprotein", also referred to as "RSV F", is a type I transmembrane surface protein that has an N terminal cleaved signal peptide and a membrane anchor near the C terminus (Collins, P. L. et al., (1984), PNAS (USA) 81:7683-7687). The RSV F protein is synthesized as an inactive 67 KDa precursor denoted as F0 (Calder, L. J.; et al., Virology (2000), 277, 122-131. The F0 protein is activated proteolytically in the Golgi complex by a furin-like protease at two sites, yielding two disulfide linked polypeptides, F2 and F1, from the N and C terminal, respectively. There is a 27 amino acid peptide released called "pep27". There are furin cleavage sites (FCS) on either side of the pep27 (Collins, P. L.; Mottet, G. (1991), J. Gen. Virol., 72: 3095-3101; Sugrue, R. J, et al. (2001), J. Gen. Virol., 82, 1375-1386). The F2 subunit consists of the Heptad repeat C (HRC), while the F1 contains the fusion polypeptide (FP), heptad repeat A (HRA), domain I, domain II, heptad repeat B (HRB), transmembrane (TM), and cytoplasmic domain (CP) (See Sun, Z. et al. Viruses (2013), 5:21 1-225). The RSV F protein plays a role in fusion of the virus particle to the host cell membrane by irreversible protein refolding from the labile prefusion conformation (herein referred to as "prefusion F" or "preF") to the stable postfusion conformation (herein referred to as "postfusion F" or "postF"). RSV F is expressed on the surface of infected cells. Accordingly, it plays a role in cell to cell transmission of the virus and syncytia formation. The amino acid sequence of the RSV F protein is provided in GenBank as accession number AAX23994.

A stabilized variant of the PreF trimeric conformation of RSV F, termed "RSV-DS-Cav1" or "DS-Cav1" disclosed in, inter alia, Stewart-Jones et al., PLos One, Vol. 10(6)): e0128779. doi: 10.1371/journal.pone.0128779 and WO 2011/050168 was used in the identification, isolation, and characterization of the disclosed antibodies.

The term "laboratory strain" as used herein refers to a strain of RSV (subtype A or subtype B) that has been passaged extensively in in vitro cell culture. A "laboratory strain" can acquire adaptive mutations that may affect their biological properties. The term "clinical strain" as used herein refers to an RSV isolate (subtype A or subtype B), which is obtained from an infected individual and has been isolated and grown in tissue culture at low passage.

The term "$IC_{50}$" refers to the "half maximal inhibitory concentration", which value measures the effectiveness of compound (e.g., anti-RSV F antibody) inhibition towards a biological or biochemical utility. This quantitative measure indicates the quantity required for a particular inhibitor to inhibit a given biological process by half. In certain embodiments, RSV virus neutralization potencies for anti-RSV neutralizing antibodies disclosed herein are expressed as neutralization $IC_{50}$ values.

The term "infant", as used herein, generally refers to a young child between one month and one year (12 months) of age; however, it can also apply to a child older than 1 year (12 months). In one embodiment, the infant is at least (≥) 6 months of age. In another embodiment, the infant is under 3 months of age.

The term "subject", as used herein, refers to a human or a nonhuman. The term "nonhuman" includes, but is not limited to, domestic animals (such as horses, dogs and cats) and livestock (such as cattle, sheep, swine, and poultry). In some embodiments, the subject is a human (and, more preferably, a human infant). The term "subject" may be interchangeably used with the term "patient" in the context of the present disclosure.

"Motavizumab", also referred to as "NUMAX™", is an enhanced potency RSV F-specific humanized monoclonal antibody derived by in vitro affinity maturation of the CDRs of the heavy and light chains of palivizumab. For reference purposes, the amino acid sequence of the NUMAX™ antibody is disclosed in U.S. Patent Publication 2003/0091584; U.S. Pat. No. 6,818,216; Wu et al., (2005) J. Mol. Bio. 350(1):126-144; and Wu, et al. (2007) J. Mol. Biol. 368: 652-665.

"Palivizumab", also referred to as "SYNAGIS®", is a humanized anti-RSV F antibody with heavy and light chain variable domains having the amino acid sequences as set forth in U.S. Pat. Nos. 7,635,568 and 5,824,307. Palivizumab immunospecifically binds to the RSV F protein, and is currently FDA-approved for the passive immunoprophylaxis of serious RSV disease in high-risk children. It is administered intramuscularly at recommended monthly doses of 15 mg/kg of body weight throughout the RSV season (November through April in the northern hemisphere). SYNAGIS® is composed of 95% human and 5% murine antibody sequences. See also Johnson et al., (1997), J. Infect. Diseases 176:1215-1224.

"MPE8" is a human monoclonal antibody (MPE8), generated by Humabs BioMed SA, that binds to antigenic site III of RSV F and potently cross-neutralizes RSV and HMPV. For reference purposes, the amino acid sequence of the MPE8 antibody is disclosed in Corti et al., 2013.

"D25" is a human IgG1 kappa monoclonal antibody, developed by AIMM Therapeutics B.V. in partnership with MedImmune, which binds to antigenic site Ø on RSV F and neutralizes RSV with high efficiency. For reference purposes, the amino acid sequence of the D25 antibody is disclosed in U.S. Pat. No. 8,562,996.

As used herein, the terms "treat," "treatment," and "treating" refer to the reduction, alleviation, or amelioration of the progression, development, recurrence, severity, and/or duration of an upper and/or lower respiratory tract RSV infection or a symptom, complication, respiratory condition related thereto (such as pneumonia or bronchiolitis) resulting from the administration of one or more therapies (including, but not limited to, the administration of one or more prophylactic or therapeutic agents alone or in combination). In certain embodiments, such terms refer to the reduction or inhibition of the replication of RSV, the inhibition or reduction in the spread of RSV to other tissues or subjects (e.g., the spread to the lower respiratory tract), the inhibition or reduction of infection of a cell with a RSV, or the amelioration of one or more symptoms associated with an upper and/or lower respiratory tract RSV infection.

As used herein, the terms "prevent," "preventing," and "prevention" refer to the prevention or inhibition of the development or onset of an upper and/or lower respiratory tract RSV infection or a respiratory condition related thereto resulting from the administration of one or more therapies (including, but not limited to, the administration of one or more prophylactic or therapeutic agents alone or in combination).

The term "antibody" ("Ab"), as used herein, refers to an immunoglobulin molecule that binds specifically to an antigen and comprises four polypeptide chains, two heavy (H) chains and two light (L) chains interconnected by disulfide bonds (i.e., "full antibody molecules") or an antigen-binding fragment thereof. Each heavy chain is comprised of a heavy chain variable region ("HCVR" or "$V_H$") and a heavy chain constant region (comprised of domains $C_H1$, $C_H2$, and $C_H3$). Each light chain is comprised of a light chain variable region ("LCVR" or "$V_L$") and a light chain constant region ($C_L$). The variable regions of the heavy and light chains contain a binding domain that interacts with an antigen. The constant regions of the antibodies may mediate the binding of the immunoglobulin to host tissues or factors, including various cells of the immune system (e.g., effector cells) and the first component (C1q) of the classical complement system.

The $V_H$ and $V_L$ regions can be further subdivided into regions of hypervariability, termed complementarity determining regions (CDRs), interspersed with regions that are more conserved, termed framework regions (FRs). Each $V_H$ and $V_L$ is composed of three CDRs and four FRs, arranged from amino-terminus to carboxy-terminus in the following order: FR1, CDR1, FR2, CDR2, FR3, CDR3, FR4. In certain embodiments of the invention, the FRs of the antibody (or antigen binding fragment thereof) may be identical to the human germline sequences, or may be naturally or artificially modified. An amino acid consensus sequence may be defined based on a side-by-side analysis of two or more CDRs. Accordingly, the CDRs in a heavy chain are designated "CHRH1", "CDRH2", and "CDRH3", respectively, and the CDRs in a light chain are designated "CDRL1", "CDRL2", and "CDRL3".

Substitution of one or more CDR residues or omission of one or more CDRs is also possible. Antibodies have been described in the scientific literature in which one or two CDRs can be dispensed with for binding. Analysis of the contact regions between antibodies and their antigens, based on published crystal structures, concluded that only about one fifth to one third of CDR residues actually contact the antigen (Padlan et al. (1995 FASEB J. 9:133-139). Also, it has been shown that in many antibodies one or two CDRs had no amino acids in contact with an antigen (see also, Vajdos et al. 2002 J Mol Biol 320:415-428).

CDR residues not contacting antigen can be identified based on previous studies (for example, residues H60-H65 in CDRH2 are often not required), from regions of Kabat CDRs lying outside Chothia CDRs, by molecular modeling and/or empirically. If a CDR or residue(s) thereof is/are omitted, it is usually substituted with an amino acid occupying the corresponding position in another human antibody sequence or a consensus of such sequences. Positions for substitution within CDRs and amino acids to substitute can also be selected empirically.

The fully human monoclonal antibodies disclosed herein may comprise one or more amino acid substitutions, insertions and/or deletions in the framework and/or CDR regions of the heavy and light chain variable domains as compared to the corresponding germline sequences. Such mutations can be readily ascertained by comparing the amino acid sequences disclosed herein to germline sequences available from, for example, public antibody sequence databases. The present invention includes antibodies, and antigen-binding fragments thereof, that are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding affinity, improved or enhanced antagonistic or agonistic biological properties (as the case may be), reduced immunogenicity, etc. Antibodies and antigen-binding fragments obtained in this general manner are encompassed within the present invention.

An immunoglobulin may derive from any of the commonly known isotypes, including but not limited to IgA, secretory IgA, IgG, and IgM. IgG subclasses are well known to those in the art and include, but are not limited to, human IgG1, IgG2, IgG3, and IgG4. "Isotype" refers to the antibody class or subclass (e.g., IgG1) that is encoded by the heavy chain constant region genes. The term "antibody" includes, by way of example, both naturally occurring and non-naturally occurring antibodies; monoclonal antibodies ("mAb") and polyclonal antibodies; chimeric and humanized antibodies; human or non-human antibodies; wholly synthetic antibodies; and single chain antibodies. Where not expressly stated, and unless the context indicates otherwise, the term "antibody" includes an antigen-binding fragment or an antigen-binding portion of any of the aforementioned immunoglobulins, a monovalent and a divalent fragment or portion, and a single chain antibody.

The term "human antibody", as used herein, is intended to include antibodies having variable and constant regions derived from human germline immunoglobulin sequences (and, thus, does not include antibodies in which CDRs derived from the germline of another mammalian species (e.g., mouse) have been grafted onto human FR sequences). The human antibodies of the invention may include amino acid residues not encoded by human germline immunoglobulin sequences (e.g., mutations introduced by random or site-specific mutagenesis in vitro or by somatic mutation in vivo), for example in the CDRs, in particular CDR3.

The term "humanized antibody", as used herein, refers to a human antibody in which one or more CDRs have been replaced with one or more corresponding CDRs obtained a non-human derived (e.g., mouse, rat, rabbit, primate) antibody. Humanized antibodies may also include certain non-CDR sequences or residues derived from such non-human antibodies as well as the one or more non-human CDR sequence. Such antibodies may also be referred to as "chimeric antibodies".

The term "recombinant" generally refers to any protein, polypeptide, or cell expressing a gene of interest that is produced by genetic engineering methods. The term "recombinant" as used herein with respect to a protein or polypeptide, means a polypeptide produced by expression of a recombinant polynucleotide. The proteins used in the immunogenic compositions of the invention may be isolated from a natural source or produced by genetic engineering methods.

The antibodies of the invention may, in some embodiments, be recombinant human antibodies. The term "recombinant human antibody", as used herein, is intended to include all antibodies (including human or humanized antibodies) that are prepared, expressed, created, or isolated by recombinant means, such as antibodies expressed using a recombinant expression vector transfected into a host cell (described further below); antibodies isolated from a recombinant, combinatorial human antibody library (described further below); antibodies isolated from an animal (e.g., a mouse) that is transgenic for human immunoglobulin genes (see, e.g., Taylor et al. (1992) Nucl. Acids Res. 20:6287-6295); or antibodies prepared, expressed, created or isolated by any other means that involve splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

The terms "specifically binds" or "binds specifically to" are used interchangeably and mean that an antibody or antigen-binding fragment thereof forms a complex with an antigen that is relatively stable under physiologic conditions. Specific binding can be characterized by an equilibrium dissociation constant of at least about $1 \times 10^{-6}$ M or less (e.g., a smaller $K_D$ denotes a tighter binding). Methods for determining whether two molecules specifically bind are well known in the art and include, for example, equilibrium dialysis, surface plasmon resonance, and the like. As described herein, antibodies have been identified by surface plasmon resonance, e.g., BIACORE™, biolayer interferometry measurements using, e.g., a ForteBio Octet HTX instrument (Pall Life Sciences), which bind specifically to RSV F. Moreover, multi-specific antibodies that bind to RSV F protein and one or more additional antigens, or a bi-specific that binds to two different regions of RSV F, are nonetheless considered antibodies that "specifically bind". In certain embodiments, the antibodies disclosed herein display equilibrium dissociation constants (and hence specificities) of about $1 \times 10^{-6}$ M; about $1 \times 10^{-7}$ M; about $1 \times 10^{-8}$ M; about $1 \times 10^{-9}$ M; about $1 \times 10^{-10}$ M about $1 \times 10^{-11}$ M; about $1 \times 10^{-12}$ M; between about $1 \times 10^{-7}$ M and about $1 \times 10^{-11}$ M; or between about $1 \times 10^{-8}$ M and about $1 \times 10^{-10}$ M.

The term "high affinity antibody" refers to those antibodies having a binding affinity to RSV F (preF or postF) of about ≤0.5 nM as measured by surface plasmon resonance, e.g., BIACORE™, biolayer interferometry measurements using, e.g., a ForteBio Octet HTX instrument (Pall Life Sciences).

The term "medium affinity antibody" refers to those antibodies having a binding affinity to RSV F of about >0.5 to 5 nM as measured by surface plasmon resonance, e.g., BIACORE™, biolayer interferometry measurements using, e.g., a ForteBio Octet HTX instrument (Pall Life Sciences).

The term "low affinity antibody" refers to those antibodies having a binding affinity to RSV F of about >5 to 50 nM as measured by surface plasmon resonance, e.g., BIACORE™, biolayer interferometry measurements using, e.g., a ForteBio Octet HTX instrument (Pall Life Sciences).

The term "weak affinity antibody" refers to those antibodies having a binding affinity to RSV F of about >50 nM as measured by surface plasmon resonance, e.g., BIACORE™, biolayer interferometry measurements using, e.g., a ForteBio Octet HTX instrument (Pall Life Sciences).

The terms "antigen-binding portion" and "antigen-binding fragment" are used interchangeably and refer to any naturally occurring, enzymatically obtainable, synthetic, or genetically engineered polypeptide or glycoprotein that specifically binds an antigen to form a complex. In certain embodiments, the terms "antigen-binding portion" and "antibody fragment" refer to one or more fragments of an antibody that retains the ability to bind to RSV F.

An antibody fragment may include a Fab fragment, a F(ab')2 fragment, a Fv fragment, a dAb fragment, a fragment containing a CDR, or an isolated CDR. Antigen-binding fragments of an antibody may be derived, e.g., from full antibody molecules using any suitable standard techniques such as proteolytic digestion or recombinant genetic engineering techniques involving the manipulation and expression of DNA encoding antibody variable and (optionally) constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add, or delete amino acids, etc.

Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g., monovalent nanobodies, bivalent nanobodies, etc.), small modular immunopharmaceuticals (SMIPs), and shark variable IgNAR domains, are also encompassed by "antigen-binding fragment" and "antigen-binding portion".

An antigen-binding fragment of an antibody will typically comprise at least one variable domain. The variable domain may be of any size or amino acid composition and will generally comprise at least one CDR, which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$, or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_h1$-$C_h2$; (v) $V_H$-$C_h1$-$C_h2$-$C_h3$; (vi) $V_H$-$C_H2$-$C_H3$; (vii) $V_H$-$C_L$; (viii) $V_L$-$C_H1$; (ix) $V_L$-$C_H2$; (x) $V_L$-$C_H3$; (xi) $V_L$-$C_H1$-$C_H2$; (xii) $V_L$-$C_H1$-$C_H2$-$C_H3$; (xiii) $V_L$-$C_H2$-$C_H3$; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids, which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be mono-specific or multi-specific (e.g., bi-specific). A multi-specific antigen-binding fragment of an antibody typically comprises at least two different variable domains, wherein each variable domain is capable of specifically binding to a separate antigen or to a different epitope on the same antigen. Any multi-specific antibody format, including the exemplary bi-specific antibody formats disclosed herein, may be adapted for use in the context of an antigen-binding fragment of an antibody of the present invention using routine techniques available in the art.

In certain embodiments, the antibody or antibody fragment is mono-specific, bi-specific, or multi-specific. Multi-specific antibodies may be specific for different epitopes of one target polypeptide or may contain antigen-binding domains specific for epitopes of more than one target polypeptide. An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise an Y96F modification (by IMGT; Y436F by EU). Further modifications that may be found within the second $C_H3$ include: D16E, L18M, N44S, K52N, V57M, and V82I (by IMGT; D356E, L358M, N384S, K392N, V397M, and V422I by EU) in the case of IgG1 monoclonal antibodies; N44S, K52N, and V82I (IMGT; N384S, K392N, and V422I by EU) in the case of IgG2 monoclonal antibodies; and Q15R, N44S, K52N, V57M, R69K, E79Q, and V82I (by IMGT; Q355R, N384S, K392N, V397M, R409K, E419Q, and V422I by EU) in the case of IgG4 monoclonal antibodies. Variations of these bi-specific antibody formats are also encompassed within the scope of the present invention.

The antibodies provided herein can be derivatized or linked to another functional molecule (e.g., another peptide or protein). Accordingly, the antibodies of the invention are intended to include derivatized and otherwise modified forms of the anti-RSV F antibodies described herein. For example, an antibody can be functionally linked (e.g., by chemical coupling, genetic fusion, noncovalent association or otherwise) to one or more other molecular entities, such as another antibody (e.g., a bispecific antibody or a diabody), a detectable agent, a cytotoxic agent, a pharmaceutical agent, and/or a protein or peptide that can mediate associate of the antibody or antibody portion with another molecule (such as a streptavidin core region or a polyhistidine tag).

One type of derivatized antibody is produced by cross-linking two or more antibodies (of the same type or of different types, e.g., to create bispecific antibodies, which is also discussed below).

Exemplary detectable agents with which an antibody of the invention may be derivatized include fluorescent compounds (such as, but not limited to, fluorescein, fluorescein isothiocyanate, rhodamine, 5-dimethylamine-1-napthalene-sulfonyl chloride, phycoerythrin and the like). An antibody may also be derivatized with detectable enzymes (such as, but not limited to, alkaline phosphatase, horseradish peroxidase, glucose oxidase and the like). When an antibody is derivatized with a detectable enzyme, it can be detected by adding additional reagents that the enzyme uses to produce a detectable reaction product (e.g., when the detectable agent horseradish peroxidase is present, the addition of hydrogen peroxide and diaminobenzidine leads to a colored reaction product, which is detectable). An antibody may also be derivatized with biotin, and detected through indirect measurement of avidin or streptavidin binding. Such derivatized anti-RSV F antibodies may be useful for the detection and/or diagnosis of RSV in a subject.

The specific embodiments, antibodies, or antibody fragments of the invention may be conjugated to a therapeutic moiety ("immunoconjugate"), such as an antibiotic, a second anti-RSV F antibody, a vaccine, a toxoid, or any other therapeutic moiety useful for treating an RSV infection.

The antibodies of the invention can also be modified by pegylation. An antibody can be pegylated to, for example, increase the biological (e.g., serum) half-life of the antibody. To pegylate, an antibody typically is reacted with a polyethylene glycol (PEG) reagent, such as a reactive ester or aldehyde derivative of PEG, under conditions in which one or more PEG groups become attached to the antibody or antibody fragment. Preferably, the pegylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (C1-C10) alkoxy- or aryloxy-polyethylene glycol or polyethylene glycol-maleimide. In certain embodiments, the antibody to be pegylated is an aglycosylated antibody. Methods for pegylating proteins are known in the art and can be applied to the antibodies described herein. See for example, EP 0154316 by Nishimura et al. and EP 0401384 by Ishikawa et al.

The term an "isolated antibody", as used herein, is intended to refer to an antibody that is substantially free of other antibodies having different antigenic specificities (e.g., an isolated antibody that specifically binds RSV F, or a fragment thereof, is substantially free of antibodies that specifically bind antigens other than RSV F).

The term a "blocking antibody" or a "neutralizing antibody", as used herein (or an "antibody that neutralizes RSV F"), is intended to refer to an antibody whose binding to RSV F results in inhibition of at least one biological activity of RSV F. For example, such an antibody may aid in blocking the fusion of RSV to a host cell, prevent syncytia formation, and/or prevent the primary disease caused by RSV. Alternatively, or in addition, such an antibody may demonstrate the ability to ameliorate at least one symptom of the RSV infection. This inhibition of the biological activity of RSV F can be assessed by measuring one or more indicators of RSV F biological activity using standard in vitro assays (such as a neutralization assay) or in vivo assays known in the art (such as animal models to look at protection from challenge with RSV following administration of one or more of the antibodies described herein).

The term "surface plasmon resonance", as used herein, refers to an optical phenomenon that allows for the analysis of real-time biomolecular interactions by detection of alterations in protein concentrations within a biosensor matrix, for example using the BIACORE™ system (Pharmacia Biosensor AB, Uppsala, Sweden and Piscataway, N.J.).

The term "$K_D$", as used herein, is intended to refer to the equilibrium dissociation constant of a particular antibody-antigen interaction.

The term "epitope", as used herein, refers to an antigenic determinant that interacts with a specific antigen binding site in the variable region of an antibody molecule known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may also be conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

The terms "substantial identity" and "substantially identical" are used interchangeably herein and, when referring to a nucleic acid or fragment thereof, indicates that, when optimally aligned with appropriate nucleotide insertions or deletions with another nucleic acid (or its complementary strand), there is nucleotide sequence identity in at least about 90%, and more preferably at least about 95%, 96%, 97%, 98%, or 99% of the nucleotide bases, as measured by any well-known algorithm of sequence identity, such as FASTA, BLAST, or GAP, as discussed below. Accordingly, nucleic acid sequences that display a certain percentage identity share that percentage identity and/or are that percentage identical to one another. A nucleic acid molecule having substantial identity to a reference nucleic acid molecule may, in certain instances, encode a polypeptide having the same or substantially similar amino acid sequence as the polypeptide encoded by the reference nucleic acid molecule.

In certain embodiments, the disclosed antibody nucleic acid sequences are, e.g., at least 70% identical; at least 75% identical; 80% identical; at least 85% identical; at least 90% identical; at least 95% identical; at least 96% identical; at least 97% identical; at least 98% identical; at least 99%; and/or all percentages of identity in between, to other sequences and/or share such percentage identities with one another (or with certain subsets of the herein-disclosed antibody sequences).

As applied to polypeptides, the term "substantial identity" or "substantially identical" means that two peptide sequences, when optimally aligned, such as by the programs GAP or BESTFIT using default gap weights, share at least 90% sequence identity, even more preferably at least 95%, 96%, 97%, 98%, or 99% sequence identity. Accordingly, amino acid sequences that display a certain percentage identity share that percentage identity and/or are that percentage identical to one another. Accordingly, amino acid sequences that display a certain percentage identity share that percentage identity and/or are that percentage identical to one another.

In certain embodiments, the disclosed antibody amino acid sequences are, e.g., at least 70% identical; at least 75% identical; 80% identical; at least 85% identical; at least 90% identical; at least 95% identical; at least 96% identical; at least 97% identical; at least 98% identical; at least 99%; and/or all percentages of identity in between, to other sequences and/or share such percentage identities with one another (or with certain subsets of the herein-disclosed antibody sequences).

Preferably, residue positions, which are not identical, differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent or degree of similarity may be adjusted upwards to correct for the conservative nature of the substitution. Means for making this adjustment are well known to those of skill in the art. (See, e.g., Pearson (1994) Methods Mol. Biol. 24: 307-331). Examples of groups of amino acids that have side chains with similar chemical properties include: 1) aliphatic side chains: glycine, alanine, valine, leucine and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45. A "moderately conservative" replacement is any change having a non-negative value in the PAM250 log-likelihood matrix.

Sequence similarity for polypeptides is typically measured using sequence analysis software. Protein analysis software matches similar sequences using measures of similarity assigned to various substitutions, deletions and other modifications, including conservative amino acid substitutions. For instance, GCG software contains programs such as GAP and BESTFIT which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA with default or recommended parameters; a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. (See, e.g., Altschul et al. (1990) J. Mol. Biol. 215: 403 410 and (1997) Nucleic Acids Res. 25:3389 402).

The phrase "therapeutically effective amount" refers to an amount of a therapeutic agent (e.g., an anti-RSV F antibody disclosed herein) that, when used alone or in combination with another therapeutic agent, protects a subject against the onset of a disease or promotes disease regression evidenced by a decrease in severity of disease symptoms, an increase in frequency and duration of disease symptom-free periods, or a prevention of impairment or disability due to the disease affliction. The ability of a therapeutic agent to promote disease regression can be evaluated using a variety of methods known to the skilled practitioner, such as in human subjects during clinical trials, in animal model systems predictive of efficacy in humans, or by assaying the activity of the agent in in vitro assays. The exact amount will depend on the purpose of the treatment, and will be ascertainable by one skilled in the art using known techniques (see, for example, Lloyd (1999) The Art, Science and Technology of Pharmaceutical Compounding).

The term "immunogenic composition" refers to a composition containing an antigen/immunogen, e.g., a microorganism (such as a virus or a bacterium) or a component thereof, a protein, a polypeptide, a fragment of a protein or polypeptide, a whole cell inactivated, subunit or attenuated virus, a polysaccharide, or combination thereof, that is administered to stimulate the recipient's humoral and/or cellular immune systems to one or more of the antigens/immunogens present in the immunogenic composition. The immunogenic compositions of the present invention can be used to treat a human susceptible to RSV infection, or suspected of having or being susceptible to RSV infection, by means of administering the immunogenic compositions via a systemic route. These administrations can include injection via the intramuscular (i.m.), intradermal (i.d.), intranasal, inhalation, or subcutaneous (s.c.) routes; application by a patch or other transdermal delivery device. In one embodiment, the immunogenic composition may be used in the manufacture of a vaccine or in the elicitation of polyclonal or monoclonal antibodies that could be used to passively protect or treat a subject.

The terms "vaccine" or "vaccine composition", which are used interchangeably, refer to a composition comprising at least one immunogenic composition that induces an immune response in a subject (e.g., a mammal, e.g., a human).

In certain embodiments, a protein of interest comprises an antigen. The terms "antigen," "immunogen," "antigenic," "immunogenic," "antigenically active," and "immunologically active", when made in reference to a molecule, refer to any substance that is capable of inducing a specific humoral and/or cell-mediated immune response. In one embodiment, the antigen comprises an epitope.

"Immunologically protective amount", as used herein, is an amount of an antigen effective to induce an immunogenic response in the recipient that is adequate to prevent or ameliorate signs or symptoms of disease, including adverse health effects or complications thereof. Either humoral immunity or cell-mediated immunity or both can be induced. The immunogenic response of an animal to a composition can be evaluated, e.g., indirectly through measurement of antibody titers, lymphocyte proliferation assays, or directly through monitoring signs and symptoms after challenge with the microorganism. The protective immunity conferred by an immunogenic composition or vaccine can be evaluated by measuring, e.g., reduction of shed of challenge organisms, reduction in clinical signs such as mortality, morbidity, temperature, and overall physical condition, health and performance of the subject. The immune response can comprise, without limitation, induction of cellular and/or humoral immunity. The amount of a composition or vaccine that is therapeutically effective can vary, depending on the particular organism used, or the condition of the animal being treated or vaccinated.

The terms "immune response" or "immunological response", as used herein, refer to the development of a humoral immune response, a cellular-immune response, or a humoral and a cellular immune response to an antigen/immunogen. A "humoral immune response" refers to one that is, at least in part, mediated by antibodies. A "cellular immune response" is one mediated by T-lymphocytes and/or other white blood cells and includes the production of cytokines, chemokines, and similar molecules produced by activated T-cells and/or white blood cells. Immune responses can be determined using standard immunoassays and neutralization assays, which are known in the art.

The term "immunogenicity", as used herein, refers to the capability of a protein or polypeptide to elicit an immune response directed specifically against a bacteria or virus that causes the identified disease.

Preparation of Human Antibodies

As disclosed herein, anti-RSV F infant antibodies may be obtained through B cell sorting techniques available to the artisan as well as those methods exemplified in the EXAMPLES below. Methods for generating human antibodies in transgenic mice are also known in the art and may also be employed to derive antibodies in accordance with the present disclosure. Any such known methods can be used in the context of the present invention to make human antibodies that specifically bind to RSV F (see, for example, U.S. Pat. No. 6,596,541).

The antibodies of the instant invention can possess affinities ($K_D$) ranging from about $1.0 \times 10^{-7}$ M to about $1.0 \times 10^{-12}$ M, when measured by binding to antigen either immobilized on solid phase or in solution phase. In some embodiments, the antibodies of the invention possess affinities ($K_D$) ranging from about $1 \times 10^{-7}$ M to about $1 \times 10^{-10}$ M, when measured by binding to antigen either immobilized on solid phase or in solution phase. In other embodiments, the antibodies of the invention possess a $K_D$ of less than 50 nM, 25 nM, 10 nM, 5 nM, 1 nM, 0.5 nM, or 0.1 nM, as measured by surface plasmon resonance.

The anti-RSV F antibodies and antibody fragments of the instant invention encompass proteins having amino acid sequences that may vary from the sequences of the described antibodies but, nonetheless, retain the ability to bind (and, in some cases, neutralize) RSV F. Such variant antibodies and antibody fragments comprise one or more additions, deletions, or substitutions of amino acids when compared to a parent sequence (i.e., amino acid sequence of a described antibody), but exhibit biological activity that is essentially equivalent to that of the described antibodies. Likewise, the antibody-encoding DNA sequences of the present invention encompass sequences that comprise one or more additions, deletions, or substitutions of nucleotides when compared to the disclosed sequence, but that encode an antibody or antibody fragment that is essentially bioequivalent to an antibody or antibody fragment described herein.

Two antigen-binding proteins (e.g., antibodies) are considered bioequivalent if, for example, they are pharmaceutical equivalents or pharmaceutical alternatives whose rate and extent of absorption do not show a significant difference when administered at the same molar dose under similar experimental conditions, either single does or multiple dose. Some antibodies will be considered equivalents or pharmaceutical alternatives if they are equivalent in the extent of their absorption but not in their rate of absorption and yet may be considered bioequivalent because such differences in the rate of absorption are intentional and are reflected in the labeling, are not essential to the attainment of effective body drug concentrations on, e.g., chronic use, and are considered medically insignificant for the particular drug product studied.

In one embodiment, two antigen-binding proteins (e.g., antibodies) are bioequivalent if there are no clinically meaningful differences in their safety, purity, and/or potency.

In another embodiment, two antigen-binding proteins (e.g., antibodies) are bioequivalent if a patient can be switched one or more times between the proteins (e.g., antibodies) without an expected increase in the risk of adverse effects, including a clinically significant change in immunogenicity, or diminished effectiveness, as compared to continued therapy without such switching.

In yet another embodiment, two antigen-binding proteins (e.g., antibodies) are bioequivalent if both proteins (e.g., antibodies) act by a common mechanism or mechanisms of action for the condition or conditions of use, to the extent that such mechanisms are known.

Bioequivalence may be demonstrated by in vivo and/or in vitro methods. Bioequivalence measures include, e.g., (a) an in vivo test in humans or other mammals, in which the concentration of the antibody or its metabolites is measured in blood, plasma, serum, or other biological fluid as a function of time; (b) an in vitro test that has been correlated with and is reasonably predictive of human in vivo bioavailability data; (c) an in vivo test in humans or other mammals in which the appropriate acute pharmacological effect of the antibody (or its target) is measured as a function of time; and (d) a well-controlled clinical trial that establishes safety, efficacy, bioavailability, and/or bioequivalence of an antibody.

Bioequivalent variants of the antibodies of the invention may be constructed by, for example, making various substitutions of residues or sequences or deleting terminal or internal residues or sequences (which may occur in the variable or binding regions as well as framework regions) not needed for biological activity. In some embodiments, it is contemplated that the anti-RSV F antibodies may contain inter alia one or more additional amino acid residue substitutions, mutations and/or modifications in the constant region (i.e., the Fc region) which result in preferred characteristics including, but not limited to: altered pharmacokinetics, increased serum half life, increase binding affinity, reduced immunogenicity, increased production, altered Fc ligand binding to an Fc receptor (FcR), enhanced or reduced ADCC (antibody-dependent cell mediated cytotoxicity) or CDC (complement-dependent cytotoxicity) activity, altered glycosylation and/or disulfide bonds and modified binding specificity. In this regard it will be appreciated that these Fc variants may advantageously be used to enhance the effective anti-neoplastic properties of the disclosed modulators. For example, cysteine residues not essential for biological activity can be deleted or replaced with other amino acids to prevent formation of unnecessary or incorrect intramolecular disulfide bridges upon renaturation. In other contexts, bioequivalent antibodies may include antibody variants comprising amino acid changes that modify the glycosylation characteristics of the antibodies, e.g., mutations that eliminate or remove glycosylation. In still other contexts, bioequivalent antibodies may include antibody variants comprising amino acid changes that modify the Fc region. Such Fc variant may have increased half-life, improved stability, and/or modified effector function(s).

Biological and Biophysical Characteristics of the Antibodies

In certain embodiments, the antibodies and antigen-binding fragments thereof specifically bind to RSV F, wherein at least one of the CDRH1, CDRH2, CDRH3, CDRL1, CDRL2, and/or CDRL3 amino acid sequences of such antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99%; and/or all percentages of identity in between, to at least one of the CDRH1, a CDRH2, a CDRH3, a CDRL1, a CDRL2, and/or a CDRL3 amino acid sequence of an antibody selected from Antibody Number 1 through Antibody Number 947 as disclosed in Table 5.

Without wishing to be bound by any theory, it is believed that the inventive antibodies and antigen-binding fragments thereof may function by binding to RSV F, preferably in the PreF conformation, and in so doing act to block the fusion of the viral membrane with the host cell membrane. The antibodies of the present invention may also function by binding to RSV F and in so doing block the cell to cell spread of the virus and block syncytia formation associated with RSV infection of cells. Subtype A is responsible for the majority of hospitalizations for RSV and RSV-related complications. Advantageously, RSV subtype A or both RSV subtype A and RSV subtype B are effectively blocked, or neutralized, by the majority of the anti-RSV antibodies disclosed herein.

In certain embodiments, the inventive antibodies and antigen-binding fragment thereof display better binding affinity for the prefusion (PreF) form of RSV F relative to the postfusion (PostF) form of RSV F. Indeed, in some embodiments, the anti-RSV F antibodies disclosed herein bind to PreF (e.g., with high affinity) but do not bind to PostF or bind to PostF with low affinity. In other embodiments, the antibodies and antigen-binding fragments thereof disclosed herein display better binding affinity for PostF than PreF.

Antibodies with a range of polyreactivity (high, medium, low, or undetectable) are disclosed. In some embodiments, the inventive antibodies and antigen-binding fragments thereof advantageously display a clean or low polyreactivity profile (see, e.g., WO 2014/179363 and Xu et al., *Protein Eng Des Sel*, Oct; 26(10):663-70. doi: 10.1093/protein/gzt047), and are thus particularly amenable to development as safe, efficacious, and developable therapeutic and/or prophylactic anti-RSV treatments.

In certain embodiments, the inventive antibodies and antigen-binding fragments thereof, without wishing to be bound by any theory, may function by blocking or inhibiting RSV fusion to the cell membrane by binding to any one or more of antigenic Sites Ø, I, II, III, IV, and/or Site V of the F protein. In certain embodiments, the antibodies disclosed herein display antigenic site specificity for Site III of (preF) RSV F and, generally, such antibodies are neutralizing antibodies (in some instances, e.g., ADI-19425, potently neutralizing). In other embodiments, the antibodies disclosed herein display antigenic site specificity for Site I of (postF) RSV F and, generally, such antibodies are non-neutralizing antibodies.

In certain embodiments, at least a portion of the epitope with which the inventive antibodies and antigen-binding fragments thereof interacts comprises the loop connecting α6 to α7 of PreF and/or β6 of PreF. In certain embodiments, the heavy chain (e.g., CDRL3) and the light chain (e.g., CDRH2) of the inventive antibodies interact with the epitope of PreF. In a particular embodiment, Tyr33 in CDRL1 and Tyr93 in CDRL3 both contact the α6-α7 loop of RSV preF and/or five consecutive serine residues, preferably followed by a tyrosine residue (Tyr56), in CDRH2 form a network of hydrogen bonds with Asp310 on β6 of RSV preF. In still further embodiments, the CDRH3 of the inventive antibodies have relatively few sequence (composition and/or length) restrictions.

In certain embodiments, the inventive antibodies and antigen-binding fragments thereof display an in vitro neutralization potency ($IC_{50}$) of greater than 0.5 ug/ml (referred to as "weak neutralization potency"); between about 0.5 ug/ml to about 5 ug/ml (referred to as "low neutralization potency"); between about 0.05 ug/ml to about 0.5 ug/ml (referred to as "medium neutralization potency"); or less than about 0.05 mg/ml (referred to as "high neutralization potency"). Neutralization potency can be measured using standard assays well known in the field, including, but not limited to, a high-throughput fluorescence plate reader neutralization assay (as described herein, see EXAMPLES).

In certain embodiments, the inventive antibodies and antigen-binding fragments thereof display at least about 2-fold; at least about 3-fold; at least about 4-fold; at least about 5-fold; at least about 6-fold; at least about 7-fold; at least about 8-fold; at least about 9-fold; at least about 10-fold; at least about 15-fold; at least about 20-fold; at least about 25-fold; at least about 30-fold; at least about 35-fold; at least about 40-fold; at least about 50-fold; at least about 55-fold; at least about 60-fold; at least about 70-fold; at least about 80-fold; at least about 90-fold; at least about 100-fold; greater than about 100-fold; and folds in between any of the foregoing; greater neutralization potency ($IC_{50}$) than motavizumab, MPE8, and D25.

In certain embodiments, the inventive antibodies and antigen-binding fragments thereof comprise the CDRH3 amino acid sequence of any one of the antibodies designated Antibody Number 1 through Antibody Number 947 as disclosed in Table 5.

In certain embodiments, the inventive antibodies and antigen-binding fragments thereof comprise the CDRH2 amino acid sequence of any one of the antibodies designated Antibody Number 1 through Antibody Number 947 as disclosed in Table 5.

In certain embodiments, the inventive antibodies and antigen-binding fragments thereof comprise the CDRH1 amino acid sequence of any one of the antibodies designated Antibody Number 1 through Antibody Number 947 as disclosed in Table 5.

In certain embodiments, the inventive antibodies and antigen-binding fragments thereof comprise the CDRL3 amino acid sequence of any one of the antibodies designated Antibody Number 1 through Antibody Number 947 as disclosed in Table 5.

In certain embodiments, the inventive antibodies and antigen-binding fragments thereof comprise the CDRL2 amino acid sequence of any one of the antibodies designated Antibody Number 1 through Antibody Number 947 as disclosed in Table 5.

In certain embodiments, the inventive antibodies and antigen-binding fragments thereof comprise the CDRL1 amino acid sequence of any one of the antibodies designated Antibody Number 1 through Antibody Number 947 as disclosed in Table 5.

In certain embodiments, the inventive antibodies and antigen-binding fragments thereof comprise any combination of two or more of the CDRH3, CDRH2, CDRH1, CDRL3, CDRL2, and CDRL1 amino acid sequences of any one of the antibodies designated Antibody Number 1 through Antibody Number 947 as disclosed in Table 5. By way of example only, the inventive antibodies and antigen-binding fragments thereof comprise the CDRL3 and the CDRH2 of any one of the antibodies designated Antibody Number 1 through Antibody Number 947 as disclosed in Table 5.

In certain embodiments, the inventive antibodies and antigen-binding fragments thereof comprise a heavy chain (HC) amino acid sequence of any one of the antibodies designated Antibody Number 1 through Antibody Number 947 as disclosed in Table 5. In certain embodiments, the inventive antibodies and antigen-binding fragments thereof comprise a light chain (LC) amino acid sequence of any one of the antibodies designated Antibody Number 1 through Antibody Number 947 as disclosed in Table 5. In certain embodiments, the inventive antibodies and antigen-binding fragments thereof comprise a heavy chain (HC) amino acid sequence and a light chain (LC) amino acid sequence of any one of the antibodies designated Antibody Number 1 through Antibody Number 947 as disclosed in Table 5.

In certain embodiments, the inventive antibodies and antigen-binding fragments thereof are each selected from the group consisting antibodies that are at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to any one of the antibodies designated as Antibody Number 1 through Antibody Number 947 as disclosed in Table 5.

In certain embodiments, the inventive antibodies and antigen-binding fragments thereof comprise are each selected from the group consisting of the antibodies designated as Antibody Number 1 through Antibody Number 947 as disclosed in Table 5.

In certain embodiments, isolated nucleic acid sequences are provided that encode antibodies (or antigen-binding fragments thereof) that specifically bind to RSV F, wherein at least one of the CDRH1, CDRH2, CDRH3, CDRL1, CDRL2, and/or CDRL3 amino acid sequences of the antibody or the antigen-binding fragment thereof is at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to at least one of the CDRH1, CDRH2, CDRH3, CDRL1, CDRL2, and/or CDRL3 amino acid sequences of an antibody selected from Antibody Number 1 through Antibody Number 947 as disclosed in Table 5. In certain embodiments, such nucleic acid sequences are selected from those nucleic acid sequences that are disclosed in Table 5 and compliments thereof.

In certain embodiments, isolated nucleic acid sequences are provided that encode the inventive antibodies and antigen-binding fragments thereof, wherein such nucleic acid sequences comprise sequences that encode the CDRH3 amino acid sequence of the antibodies designated Antibody Number 1 through Antibody Number 947 as disclosed in Table 5. In certain embodiments, such nucleic acid sequences are selected from those nucleic acid sequences that are disclosed in Table 5 and compliments thereof.

In certain embodiments, isolated nucleic acid sequences are provided that encode the inventive antibodies and antigen-binding fragments thereof, wherein such nucleic acid sequences comprise sequences that encode the CDRH2 amino acid sequences of the antibodies designated Antibody Number 1 through Antibody Number 947 as disclosed in Table 5. In certain embodiments, such nucleic acid sequences are selected from those nucleic acid sequences that are disclosed in Table 5 and compliments thereof.

In certain embodiments, isolated nucleic acid sequences are provided that encode the inventive antibodies and antigen-binding fragments thereof, wherein such nucleic acid sequences comprise sequences that encode the CDRH1 amino acid sequences of the antibodies designated Antibody Number 1 through Antibody Number 947 as disclosed in Table 5. In certain embodiments, such nucleic acid sequences are selected from those nucleic acid sequences that are disclosed in Table 5 and compliments thereof.

In certain embodiments, isolated nucleic acid sequences are provided that encode the inventive antibodies and antigen-binding fragments thereof, wherein such nucleic acid sequences comprise sequences that encode the CDRL3 amino acid sequences of the antibodies designated Antibody Number 1 through Antibody Number 947 as disclosed in Table 5. In certain embodiments, such nucleic acid sequences are selected from those nucleic acid sequences that are disclosed in Table 5 and compliments thereof.

In certain embodiments, isolated nucleic acid sequences are provided that encode the inventive antibodies and antigen-binding fragments thereof, wherein such nucleic acid sequences comprise sequences that encode the CDRL2 amino acid sequences of the antibodies designated Antibody Number 1 through Antibody Number 947 as disclosed in Table 5. In certain embodiments, such nucleic acid sequences are selected from those nucleic acid sequences that are disclosed in Table 5 and compliments thereof.

In certain embodiments, isolated nucleic acid sequences are provided that encode the inventive antibodies and antigen-binding fragments thereof, wherein such nucleic acid sequences comprise sequences that encode the CDRL1 amino acid sequences of the antibodies designated Antibody Number 1 through Antibody Number 947 as disclosed in Table 5. In certain embodiments, such nucleic acid sequences are selected from those nucleic acid sequences that are disclosed in Table 5 and compliments thereof.

In certain embodiments, isolated nucleic acid sequences are provided that encode the inventive antibodies and antigen-binding fragments thereof, wherein such nucleic acid sequences comprise sequences that encode the heavy chain (HC) amino acid sequences of the antibodies designated Antibody Number 1 through Antibody Number 947 as disclosed in Table 5. In certain embodiments, such nucleic acid sequences are selected from those nucleic acid sequences that are disclosed in Table 5 and compliments thereof.

In certain embodiments, isolated nucleic acid sequences are provided that encode the inventive antibodies and antigen-binding fragments thereof, wherein such nucleic acid sequences comprise sequences that encode the light chain (LC) amino acid sequences of the antibodies designated Antibody Number 1 through Antibody Number 947 as disclosed in Table 5. In certain embodiments, such nucleic acid sequences are selected from those nucleic acid sequences that are disclosed in Table 5 and compliments thereof.

In certain embodiments, isolated nucleic acid sequences are provided that encode the inventive antibodies and antigen-binding fragments thereof, wherein such nucleic acid sequences comprise sequences that are each selected from the group consisting of sequences that are at least 70% identical; at least 75% identical; 80% identical; at least 85% identical; at least 90% identical; at least 95% identical; at least 96% identical; at least 97% identical; at least 98% identical; at least 99%; and/or all percentages of identity in between; to any one of the nucleic acid sequences that are disclosed in Table 5 and compliments thereof.

In certain embodiments, isolated nucleic acid sequences are provided that encode the inventive antibodies and antigen-binding fragments thereof, wherein such nucleic acid sequences comprise sequences selected from the nucleic acid sequences that are disclosed in Table 5 and compliments thereof.

In certain embodiments, expression vectors are provided comprising the isolated nucleic acid sequences disclosed herein. In some embodiments, a single expression vector comprises the isolated nucleic acid sequences (e.g., $V_H$ and $V_L$, or HC and LC, are contained in the same vector). In this case, host cells are transfected, transformed, or transduced with a single expression vector. However, in other embodiments, more than one expression vector comprises the isolated nucleic acid sequences (e.g., $V_H$ and $V_L$, or HC and LC, are each contained in a different vector). In this case, host cells are transfected, transformed, or transduced with more than one expression vector.

Host cells transfected, transformed, or transduced with the nucleic acid sequences and/or the expression vectors themselves are also encompassed by the subject invention.

Epitope Mapping and Related Technologies

As described above and as demonstrated in the EXAMPLES, Applicant has characterized inter alia the epitope binding of the inventive antibodies and antigen-binding fragments thereof. In addition to the methods utilized by Applicant, various other techniques are available to the skilled artisan that can be used to carry out such characterization or to otherwise ascertain whether an antibody "interacts with one or more amino acids" within a polypeptide or protein. Exemplary techniques include, for example, a routine cross-blocking assay such as that described Antibodies, Harlow and Lane (Cold Spring Harbor Press, Cold Spring Harb., N.Y.) can be performed. Other methods include alanine scanning mutational analysis, peptide blot analysis (Reineke (2004) Methods Mol Biol 248: 443-63), peptide cleavage analysis crystallographic studies and NMR analysis. In addition, methods such as epitope excision, epitope extraction and chemical modification of antigens can be employed (Tomer (2000) Protein Science 9: 487-496). Another method that can be used to identify the amino acids within a polypeptide with which an antibody interacts is hydrogen/deuterium exchange detected by mass spectrometry. In general terms, the hydrogen/deuterium exchange method involves deuterium-labeling the protein of interest, followed by binding the antibody to the deuterium-labeled protein. Next, the protein/antibody complex is transferred to water and exchangeable protons within amino acids that are protected by the antibody complex undergo deuterium-to-hydrogen back-exchange at a slower rate than exchangeable protons within amino acids that are not part of the interface. As a result, amino acids that form part of the protein/antibody interface may retain deuterium and therefore exhibit relatively higher mass compared to amino acids not included in the interface. After dissociation of the antibody, the target protein is subjected to protease cleavage and mass spectrometry analysis, thereby revealing the deuterium-labeled residues that correspond to the specific amino acids with which the antibody interacts. See, e.g., Ehring (1999) Analytical Biochemistry 267 (2):252-259; Engen and Smith (2001) Anal. Chem. 73:256A-265A.

As the artisan will understand, an epitope can be formed both from contiguous amino acids or noncontiguous amino acids juxtaposed by tertiary folding of a protein. Epitopes formed from contiguous amino acids are typically retained on exposure to denaturing solvents, whereas epitopes formed by tertiary folding are typically lost on treatment with denaturing solvents. An epitope typically includes at least 3, and more usually, at least 5 or 8-10 amino acids in a unique spatial conformation.

Modification-Assisted Profiling (MAP), also known as Antigen Structure-based Antibody Profiling (ASAP) is a method that categorizes large numbers of monoclonal antibodies (mAbs) directed against the same antigen according to the similarities of the binding profile of each antibody to chemically or enzymatically modified antigen surfaces (see, e.g., US 2004/0101920). Each category may reflect a unique epitope either distinctly different from or partially overlapping with epitope represented by another category. This technology allows rapid filtering of genetically identical antibodies, such that characterization can be focused on genetically distinct antibodies. When applied to hybridoma screening, MAP may facilitate identification of rare hybridoma clones that produce mAbs having the desired characteristics. MAP may be used to sort the antibodies of the invention into groups of antibodies binding different epitopes.

As the artisan understands, one can easily determine whether an antibody binds to the same epitope as, or competes for binding with, a reference anti-RSV F antibody by using routine methods available in the art. For example, to determine if a test antibody binds to the same epitope as a reference RSV F antibody of the invention, the reference antibody is allowed to bind to a RSV F protein or peptide under saturating conditions. Next, the ability of a test antibody to bind to the RSV F molecule is assessed. If the test antibody is able to bind to RSV F following saturation binding with the reference anti-RSV F antibody, it can be concluded that the test antibody binds to a different epitope than the reference anti-RSV F antibody. On the other hand, if the test antibody is not able to bind to the RSV F molecule following saturation binding with the reference anti-RSV F antibody, then the test antibody may bind to the same epitope as the epitope bound by the reference anti-RSV F antibody of the invention.

To determine if an antibody competes for binding with a reference anti-RSV F antibody, the above-described binding methodology is performed in two orientations. In a first orientation, the reference antibody is allowed to bind to a RSV F molecule under saturating conditions followed by assessment of binding of the test antibody to the RSV F molecule. In a second orientation, the test antibody is allowed to bind to a RSV F molecule under saturating conditions followed by assessment of binding of the reference antibody to the RSV F molecule. If, in both orientations, only the first (saturating) antibody is capable of binding to the RSV F molecule, then it is concluded that the test antibody and the reference antibody compete for binding to RSV F. As will be appreciated by a person of ordinary skill in the art, an antibody that competes for binding with a reference antibody may not necessarily bind to the identical epitope as the reference antibody, but may sterically block binding of the reference antibody by binding an overlapping or adjacent epitope.

Two antibodies bind to the same or overlapping epitope if each competitively inhibits (blocks) binding of the other to the antigen. That is, a 1-, 5-, 10-, 20-, or 100-fold excess of one antibody inhibits binding of the other by at least 50% but preferably 75%, 90% or even 99% as measured in a competitive binding assay (see, e.g., Junghans et al., Cancer Res. (1990) 50:1495-1502). Alternatively, two antibodies have the same epitope if essentially all amino acid mutations in the antigen that reduce or eliminate binding of one antibody reduce or eliminate binding of the other. Two antibodies have overlapping epitopes if some amino acid mutations that reduce or eliminate binding of one antibody reduce or eliminate binding of the other.

Additional routine experimentation (e.g., peptide mutation and binding analyses) can then be carried out to confirm whether the observed lack of binding of the test antibody is in fact due to binding to the same epitope as the reference antibody or if steric blocking (or another phenomenon) is responsible for the lack of observed binding. Experiments of this sort can be performed using ELISA, RIA, surface plasmon resonance, flow cytometry or any other quantitative or qualitative antibody-binding assay available in the art.

Immunoconjugates

The invention encompasses a RSV F antibody conjugated to a therapeutic moiety ("immunoconjugate"), such as an agent that is capable of reducing the severity of primary infection with RSV, or ameliorating at least one symptom associated with RSV infection, including coughing, fever, pneumonia, or the severity thereof. Such an agent may be a second different antibody to RSVF or a vaccine. The type of therapeutic moiety that may be conjugated to the anti-RSV F antibody and will take into account the condition to be treated and the desired therapeutic effect to be achieved. Alternatively, if the desired therapeutic effect is to treat the sequelae or symptoms associated with RSV infection, or any other condition resulting from such infection, such as, but not limited to, pneumonia, it may be advantageous to conjugate an agent appropriate to treat the sequelae or symptoms of the condition, or to alleviate any side effects of the antibodies of the invention. Examples of suitable agents for forming immunoconjugates are known in the art, see for example, WO 05/103081.

Multi-specific Antibodies

The antibodies of the present invention may be mono-specific, bi-specific, or multi-specific. Multi-specific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244. As discussed above, the antibodies of the present invention can be linked to or co-expressed with another functional molecule, e.g., another peptide or protein. For example, an antibody or fragment thereof can be functionally linked (e.g., by chemical coupling, genetic fusion, noncovalent association or otherwise) to one or more other molecular entities, such as another antibody or antibody fragment to produce a bi-specific or a multi-specific antibody with a second binding specificity.

An exemplary bi-specific antibody format that can be used in the context of the present invention involves the use of a first immunoglobulin (Ig) $C_H3$ domain and a second Ig $C_H3$ domain, wherein the first and second Ig $C_H3$ domains differ from one another by at least one amino acid, and wherein at least one amino acid difference reduces binding of the bi-specific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise a Y96F modification (by IMGT; Y436F by EU). Further modifications that may be found within the second $C_H3$ include: D16E, L18M, N44S, K52N, V57M, and V82I (by IMGT; D356E, L358M, N384S, K392N, V397M, and V422I by EU) in the case of lgG1 antibodies; N44S, K52N, and V82I (IMGT; N384S, K392N, and V422I by EU) in the case of lgG2 antibodies; and Q15R, N44S, K52N, V57M, R69K, E79Q, and V82I (by IMGT; Q355R, N384S, K392N, V397M, R409K, E419Q, and V422I by EU) in the case of lgG4 antibodies. Variations on the bi-specific antibody format described above are contemplated within the scope of the present invention.

Therapeutic Administration and Formulations

The invention provides therapeutic compositions comprising the inventive anti-RSV F antibodies or antigen-binding fragments thereof. The administration of therapeutic compositions in accordance with the invention will be administered with suitable carriers, excipients, and other agents that are incorporated into formulations to provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose of each of the antibodies of the invention may vary depending upon the age and the size of a subject to be administered, target disease, conditions, route of administration, and the like. When the antibodies of the present invention are used for treating a RSV infection in a patient, or for treating one or more symptoms associated with a RSV infection, such as the cough or pneumonia associated with a RSV infection in a patient, or for lessening the severity of the disease, it is advantageous to administer each of the antibodies of the present invention intravenously or subcutaneously normally at a single dose of about 0.01 to about 30 mg/kg body weight, more preferably about 0.1 to about 20 mg/kg body weight, or about 0.1 to about 15 mg/kg body weight, or about 0.02 to about 7 mg/kg body weight, about 0.03 to about 5 mg/kg body weight, or about 0.05 to about 3 mg/kg body weight, or about 1 mg/kg body weight, or about 3.0 mg/kg body weight, or about 10 mg/kg body weight, or about 20 mg/kg body weight. Multiple doses may be administered as necessary. Depending on the severity of the condition, the frequency and the duration of the treatment can be adjusted. In certain embodiments, the antibodies or antigen-binding fragments thereof of the invention can be administered as an initial dose of at least about 0.1 mg to about 800 mg, about 1 to about 600 mg, about 5 to about 300 mg, or about 10 to about 150 mg, to about 100 mg, or to about 50 mg. In certain embodiments, the initial dose may be followed by administration of a second or a plurality of subsequent doses of the antibodies or antigen-binding fragments thereof in an amount that can be approximately the same or less than that of the initial dose, wherein the subsequent doses are separated by at least 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu et al. (1987) J. Biol. Chem. 262:4429-4432). Methods of introduction include, but are not limited to, intradermal, transdermal, intramuscular, intraperitoneal, intravenous, subcutaneous, intranasal, epidural and oral routes. The composition may be administered by any convenient route, for example by infusion or bolus injection, by absorption through epithelial or mucocutaneous linings {e.g., oral mucosa, nasal mucosa, rectal and intestinal mucosa, etc.) and may be administered together with other biologically active agents. Administration can be systemic or local. It may be delivered as an aerosolized formulation (See U.S. Publication No. 2011/0311515 and U.S. Publication No. 2012/0128669). The delivery of agents useful for treating respiratory diseases by inhalation is becoming more widely accepted (See A. J. Bitonti and J. A. Dumont, (2006), Adv.

Drug Deliv. Rev, 58:1 106-1 1 18). In addition to being effective at treating local pulmonary disease, such a delivery mechanism may also be useful for systemic delivery of antibodies (See Maillet et al. (2008), Pharmaceutical Research, Vol. 25, No. 6, 2008).

The pharmaceutical composition can be also delivered in a vesicle, in particular a liposome (see, for example, Langer (1990) Science 249:1527-1533).

In certain situations, the pharmaceutical composition can be delivered in a controlled release system. In one embodiment, a pump may be used. In another embodiment, polymeric materials can be used. In yet another embodiment, a controlled release system can be placed in proximity of the composition's target, thus requiring only a fraction of the systemic dose.

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but certainly are not limited to AUTOPEN™ (Owen Mumford, Inc., Woodstock, UK), DISETRONIC™ pen (Disetronic Medical Systems, Burghdorf, Switzerland), HUMALOG MIX 75/25™ pen, HUMALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™ OPTIPEN STARLET™, and OPTICLIK™ (sanofi-aventis, Frankfurt, Germany), to name only a few. Examples of disposable pen delivery devices having applications in subcutaneous delivery of a pharmaceutical composition of the present invention include, but certainly are not limited to the SOLOSTAR™ pen (sanofi-aventis), the FLEXPEN™ (Novo Nordisk), and the KWIKPEN™ (Eli Lilly), the SURECLICK™ Autoinjector (Amgen, Thousands Oaks, Calif.), the PENLET™ (Haselmeier, Stuttgart, Germany), the EPIPEN (Dey, L.P.) and the HUMIRA™ Pen (Abbott Labs, Abbott Park, Ill.), to name only a few.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

Administration Regimens

According to certain embodiments, multiple doses of an antibody to RSV F may be administered to a subject over a defined time course. The methods according to this aspect of the invention comprise sequentially administering to a subject multiple doses of an antibody to RSV F. As used herein, "sequentially administering" means that each dose of antibody to RSV F is administered to the subject at a different point in time, e.g., on different days separated by a predetermined interval (e.g., hours, days, weeks or months). The present invention includes methods which comprise sequentially administering to the patient a single initial dose of an antibody to RSV F, followed by one or more secondary doses of the antibody to RSV F and, optionally, followed by one or more tertiary doses of the antibody to RSV F.

The terms "initial dose," "secondary doses," and "tertiary doses," refer to the temporal sequence of administration of the antibody to RSV F. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of antibody to RSV F, but generally may differ from one another in terms of frequency of administration. In certain embodiments, however, the amount of antibody to RSV F contained in the initial, secondary and/or tertiary doses vary from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In one exemplary embodiment of the present invention, each secondary and/or tertiary dose is administered 1 to 26 (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21 ½, 22, 22½, 23, 23½, 24, 24½, 25, 25½, 26, 26½, or more) weeks after the immediately preceding dose. The phrase "the immediately preceding dose," as used herein, means that in a sequence of multiple administrations, the dose of antibody to RSV F, which is administered to a patient prior to the administration of the very next dose in the sequence with no intervening doses.

The methods according to this aspect of the invention may comprise administering to a patient any number of secondary and/or tertiary doses of an antibody to RSV F. For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In embodiments involving multiple secondary doses, each secondary dose may be administered at the same frequency as the other secondary doses. For example, each secondary dose may be administered to the patient 1 to 2 weeks after the immediately preceding dose. Similarly, in embodiments involving multiple tertiary doses, each tertiary dose may be administered at the same frequency as the other tertiary doses. For example, each tertiary dose may be administered to the patient 2 to 4 weeks after the immediately preceding dose. Alternatively, the frequency at which the secondary and/or tertiary doses are administered to a patient can vary over the course of the treatment regimen. The frequency of administration may also be adjusted during the course of treatment by a physician depending on the needs of the individual patient following clinical examination.

Accordingly, in certain embodiments are provided pharmaceutical compositions comprising: one or more of the inventive antibodies or antigen-binding fragments thereof disclosed herein and throughout and a pharmaceutically acceptable carrier and/or one or more excipients. In certain other embodiments are provided pharmaceutical compositions comprising: one or more nucleic acid sequences encoding one or more inventive antibodies or antigen-binding fragments thereof; or one or more the expression vectors harbouring such nucleic acid sequences; and a pharmaceutically acceptable carrier and/or one or more excipients.

Therapeutic Uses of the Antibodies

Due to their binding to and interaction with RSV F, it is believed that the inventive antibodies and antigen-binding fragments thereof are useful for preventing fusion of the virus with the host cell membrane, preventing cell to cell virus spread, and/or inhibiting syncytia formation. Additionally, a subset of the inventive anti-RSV antibodies and antigen-binding fragments thereof display specificity for RSV (i.e., epitopic specificity) that is unique from the specificity of adult anti-RSV antibodies. Therefore, the inventive antibodies and antigen-binding fragments thereof may be advantageous for preventing and/or treating an RSV infection in an infant. As such, the antibodies of the invention are contemplated for prophylactic use in infant, particularly pre-term infants and full-term infants born during RSV season (late fall to early spring). It is contemplated that the antibodies of the invention may be used alone, or in conjunction with one or more additional agents, for treating or preventing RSV infection or at least one symptom or complication associated with RSV infection. The second or third agents may be delivered concurrently with or separately (before or after) from the antibodies of the invention. The one or more additional agents may be an anti-viral (e.g., ribavirin), an NSAID or other agents to reduce fever or pain, another antibody that specifically binds RSV-F, an agent (e.g. an antibody) that binds to another RSV antigen (e.g., RSV G), a vaccine against RSV, and/or an siRNA specific for an RSV antigen.

In yet a further embodiment of the invention, the present antibodies are used for the preparation of a pharmaceutical composition for treating patients suffering from a RSV infection. The pharmaceutical composition can reduce the severity of a primary infection with RSV, reduce the duration of the infection, and/or reduce at least one symptom associated with the RSV infection. In a further embodiment, the anti-RSV F antibodies disclosed herein are used as adjunct therapy with any other agent useful for treating an RSV infection, including an antiviral, a toxoid, a vaccine, a second RSV-F antibody, or another antibody specific for an RSV antigen, including an RSV-G antibody, or any other palliative therapy known to those skilled in the art.

Accordingly, the disclosure provides methods of treating or preventing RSV infection, or at least one symptom associated with RSV infection, comprising administering to a patient in need thereof (or suspected of being in need thereof) one or more of the inventive antibodies or antigen-binding fragments thereof, e.g., one or more of the anti-RSV F antibodies disclosed in Table 5, such that the RSV infection is treated or prevented, or the at least on symptom associated with RSV infection is treated, alleviated, or reduced in severity.

Other embodiments provide methods of treating or preventing a RSV infection, or at least one symptom associated with RSV infection, comprising administering to a patient in need thereof (or suspected of being in need thereof) a nucleic acid sequence encoding one or more of the inventive antibodies or antigen-binding fragments thereof, such nucleic acid sequenced disclosed in Table 5 and compliments thereof, such that the RSV infection is treated or prevented, or the at least on symptom associated with RSV infection is treated, alleviated, or reduced in severity.

Additional embodiments provide methods of treating or preventing a RSV infection, or at least one symptom associated with RSV infection, comprising administering to a patient in need thereof (or suspected of being in need thereof) a host cell harboring a nucleic acid sequence or an expression vector comprising such a nucleic acid sequence, wherein such nucleic acid sequences is selected from the group consisting of sequences disclosed in Table 5 and compliments thereof, such that the RSV infection is treated or prevented, or the at least one symptom associated with RSV infection is treated, alleviated, or reduced in severity.

Further embodiments provide methods of treating or preventing a RSV infection, or at least one symptom associated with RSV infection, comprising administering to a patient in need thereof (or suspected of being in need thereof) a pharmaceutical composition comprising one or more of the inventive antibodies or antigen-binding fragments thereof as disclosed in Table 5, or one or more nucleic acid sequences or an expression vectors comprising such a nucleic acid sequence, wherein such nucleic acid sequences are selected from the group consisting of sequences disclosed in Table 5 and compliments thereof; one or more host cells harboring one or more nucleic acid sequences or an expression vectors comprising such one or more nucleic acid sequences, wherein such nucleic acid sequences are selected from the group consisting of sequences disclosed in Table 5 and compliments thereof; and a pharmaceutically acceptable carrier and/or one or more excipients, such that the RSV infection is treated or prevented, or the at least on symptom associated with RSV infection is treated, alleviated, or reduced in severity.

The anti-RSV F antibodies disclosed herein may also be suitable for therapeutic and/or prophylactic use in non-humans, e.g., cattle, swine, sheep, or poultry.

Combination Therapies

As noted above, according to certain embodiments, the disclosed methods comprise administering to the subject one or more additional therapeutic agents in combination with an antibody to RSV F. As used herein, the expression "in combination with" means that the additional therapeutic agents are administered before, after, or concurrent with the pharmaceutical composition comprising the anti-RSV F antibody. The term "in combination with" also includes sequential or concomitant administration of the anti-RSV F antibody and a second therapeutic agent.

For example, when administered "before" the pharmaceutical composition comprising the anti-RSV F antibody, the additional therapeutic agent may be administered about 72 hours, about 60 hours, about 48 hours, about 36 hours, about 24 hours, about 12 hours, about 10 hours, about 8 hours, about 6 hours, about 4 hours, about 2 hours, about 1 hour, about 30 minutes, about 15 minutes or about 10 minutes prior to the administration of the pharmaceutical composition comprising the anti-RSV F antibody. When administered "after" the pharmaceutical composition comprising the anti-RSV-F antibody, the additional therapeutic agent may be administered about 10 minutes, about 15 minutes, about 30 minutes, about 1 hour, about 2 hours, about 4 hours, about 6 hours, about 8 hours, about 10 hours, about 12 hours, about 24 hours, about 36 hours, about 48 hours, about 60 hours or about 72 hours after the administration of the pharmaceutical composition comprising the anti-RSV F antibodies. Administration "concurrent" or with the pharmaceutical composition comprising the anti-RSV F antibody means that the additional therapeutic agent is administered to the subject in a separate dosage form within less than 5 minutes (before, after, or at the same time) of administration of the pharmaceutical composition comprising the anti-RSV F antibody, or administered to the subject as a single combined dosage formulation comprising both the additional therapeutic agent and the anti-RSV F antibody.

Combination therapies may include an anti-RSV F antibody of the invention and any additional therapeutic agent that may be advantageously combined with an antibody of the invention, or with a biologically active fragment of an antibody of the invention.

For example, a second or third therapeutic agent may be employed to aid in reducing the viral load in the lungs, such as an antiviral, for example, ribavirin. The antibodies may also be used in conjunction with other therapies, as noted above, including a toxoid, a vaccine specific for RSV, a second antibody specific for RSV F, or an antibody specific for another RSV antigen, such as RSV G.

Diagnostic Uses of the Antibodies

The inventive anti-RSV antibodies and antigen-binding fragments thereof may also be used to detect and/or measure RSV in a sample, e.g., for diagnostic purposes. It is envisioned that confirmation of an infection thought to be caused by RSV may be made by measuring the presence of the virus through use of any one or more of the antibodies of the invention. Exemplary diagnostic assays for RSV may comprise, e.g., contacting a sample, obtained from a patient, with an anti-RSV F antibody of the invention, wherein the anti-RSV F antibody is labeled with a detectable label or reporter molecule or used as a capture ligand to selectively isolate the virus containing the F protein from patient samples. Alternatively, an unlabeled anti-RSV F antibody can be used in diagnostic applications in combination with a secondary antibody which is itself detectably labeled. The detectable label or reporter molecule can be a radioisotope, such as $^{3}H$, $^{14}C$, $^{32}P$ $^{35}S$, or $^{125}I$; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure RSV containing the F protein in a sample include enzyme-linked immunosorbent assay (ELISA), radioimmunoassay (MA), and fluorescence-activated cell sorting (FACS).

Samples that can be used in RSV diagnostic assays according to the present invention include any tissue or fluid sample obtainable from a patient, which contains detectable quantities of RSV F protein, or fragments thereof, under normal or pathological conditions. Generally, levels of RSV F in a particular sample obtained from a healthy patient (e.g., a patient not afflicted with a disease or condition associated with the presence of RSV F) will be measured to initially establish a baseline, or standard, level of the F protein from RSV. This baseline level of RSV F can then be compared against the levels of RSV F measured in samples obtained from individuals suspected of having an RSV infection or symptoms associated with such infection.

EXAMPLES

Example 1. Isolation and Characterization of Anti-RSV F-Specific Human Infant Antibodies from Memory B Cells Applicant has comprehensively profiled the human infant antibody response to RSV F by isolating and characterizing over 450 RSV F-specific monoclonal antibodies from the memory B cells of RSV-infected infants, and used these antibodies to characterize the infant antibody response as well as develop a framework for the rational design of age-specific RSV vaccines. The antibody responses were highly biased, with half of the antibodies recognizing only two antigenic sites. Antibodies targeting both sites showed convergent sequence features, the molecular determinants of which were revealed by X-ray crystallographic studies. A subset of antibodies targeting one of the sites displayed potent neutralizing activity despite lacking somatic mutations, suggesting suitably designed vaccines may be used to induce such antibodies in young infants.

RSV F-Specific Antibodies Isolated from Young Infants have Low Levels of SHM and Biased $V_H$ and $V_L$ Germline Gene Usage To analyze infant B cell responses to RSV F, blood samples from seven infants that were hospitalized due to complications associated with RSV infection were obtained. Of the seven infants, five were less than three months (<3 mo.) and two were at least six months (>6 mo.) of age at the time of hospitalization (Table 1). Blood was drawn from seven infants hospitalized with bronchiolitis and confirmed RSV infection.

TABLE 1

Clinical information for infant donors

| ID | Estimated gestational age (weeks) | Birth weight (kg) | Hospital stay (days) | Intensity of care[a] | Intubation | Age at admission (months) | Age at blood draw (months) |
|---|---|---|---|---|---|---|---|
| 2308 | 39 | 3.29 | 5 | R | N | 0.35 | 1.35 |
| 2026 | 37 | 2.41 | 7 | I | N | 0.96 | 2.75 |
| 2301 | 40 | 4.5 | 4 | R | CPAP | 1.48 | 3.00 |
| 2021 | 33 | 2.21 | 15 | I | N | 1.61 | 4.46 |
| 2201 | 39 | 4.39 | 3 | I | N | 2.54 | 12.35 |
| 856 | 32.5 | 2.07 | 3 | I | N | 6.00 | 10.61 |
| 2042 | 38 | 3.29 | 1 | I | Y | 26.64 | 29.57 |

[a] R, routine; I, intensive, all patients were administered $O_2$.

Figure 1B:
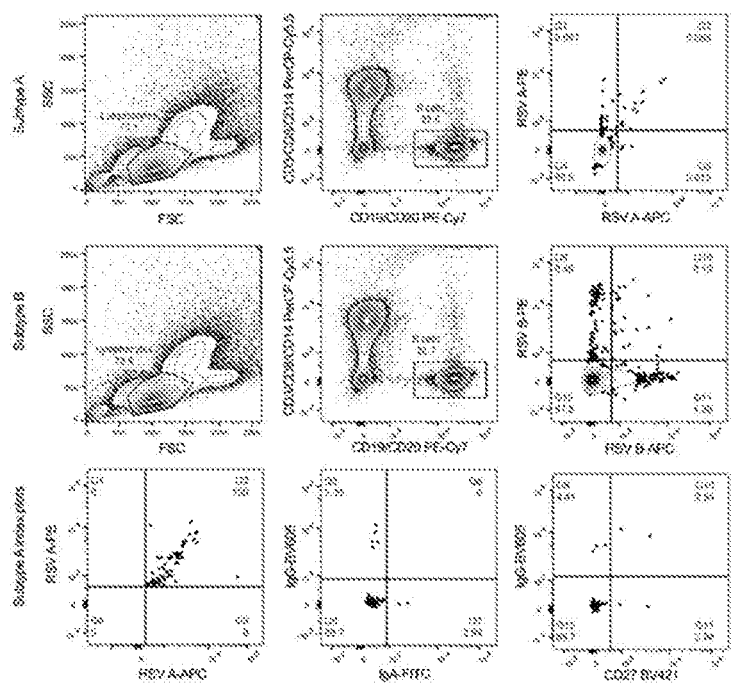
Figure 1C:
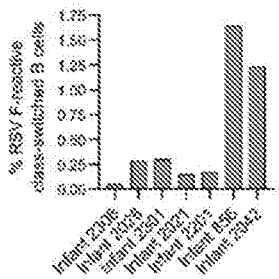
Figure 2A:
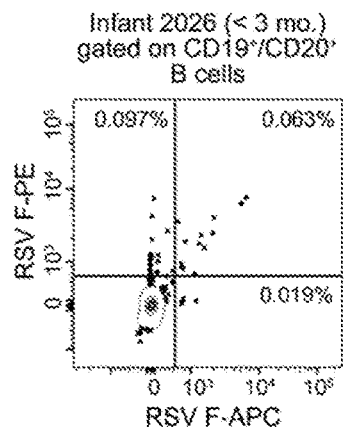
FIGS. 2A-2E show that anti-RSV F antibodies isolated from infant B cells display limited somatic hypermutation (SHM) and biased $V_H$ and $V_L$ gene usage. A representative flow plot is shown for the RSV F-specific B cell response in an infant <3 months of age (FIG. 2A) and an infant >6 months of age (FIG. 2B). Prior to sorting on double positive staining with dual labeled RSV F probes, the plot was gated on $CD3^-$ $CD19^+$ $CD20^+$ B cells (FIG. 1A) or $CD3$ $CD19^+$ $CD20^+$ $IgG/IgA^+$ B cells (FIG. 2B). RSV F-specific B cells are in the upper right quadrant of the plots.
Figure 2B:
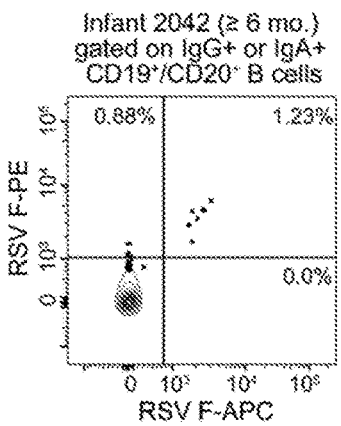
Figure 2C:
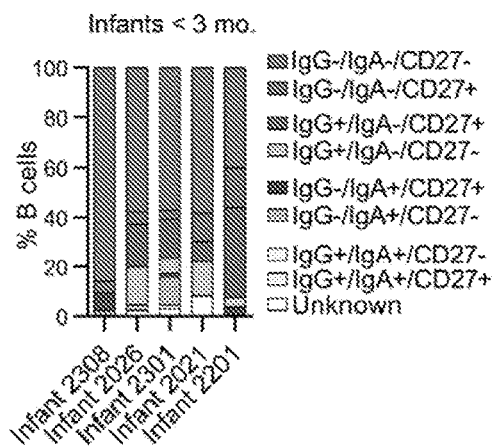

Six out of the seven infants were infected during the first RSV season of their life and were therefore likely experiencing a primary infection. The remaining donor, who was 29.5 months old at the time of blood draw, was also likely experiencing a primary infection because secondary RSV infections generally do not result in hospitalization (Glezen et al., 1986). To assess the magnitude of the B cell response to RSV F, peripheral blood mononuclear cells (PBMCs) were stained with fluorescently labeled tetramers of preF and postF trimers and analyzed by flow cytometry (FIGS. 1A and 1B). The frequency of class-switched B cells that were RSV F-specific was substantially lower in infants <3 mo. compared with infants ≥6 mo. (FIG. 1C). In infants <3 mo., the frequency of RSV F-specific class-switched B cells ranged from 0.05-0.3%, whereas in infants ≥6 mo. the frequency ranged from 1.2-1.6%. To dissect the RSV F-specific B cell response, between 100 and 300 RSV F-reactive B cells from each donor were single-cell sorted and the antibody variable heavy (VH)- and variable light (VL)-chain sequences were rescued by single-cell PCR (Tiller et al., 2008). Due to the low frequency of RSV F-specific class-switched B cells in the five younger infants, all B cells that reacted with RSV F were single-cell sorted (FIG. 2A). For the two infants that were ≥6 mo., only class-switched B cells were sorted (FIG. 2B). Although all B cells that reacted with RSV F were sorted from infants <3 mo., index sorting was performed in order to analyze the B cell surface markers expressed on each sorted cell. This analysis revealed that 14-60% of the RSV F-specific B cells sorted from infants <3 mo. were class-switched and/or CD27$^+$, with the remaining B cells lacking classical memory markers (FIG. 2C), suggesting that RSV infection induces more robust B cell responses in infants ≥6 mo. compared with infants <3 mo.

Figure 2D:
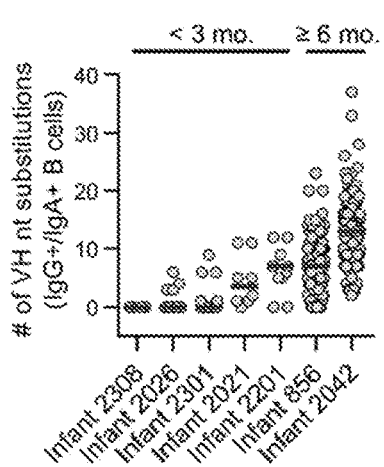
Figure 2E:
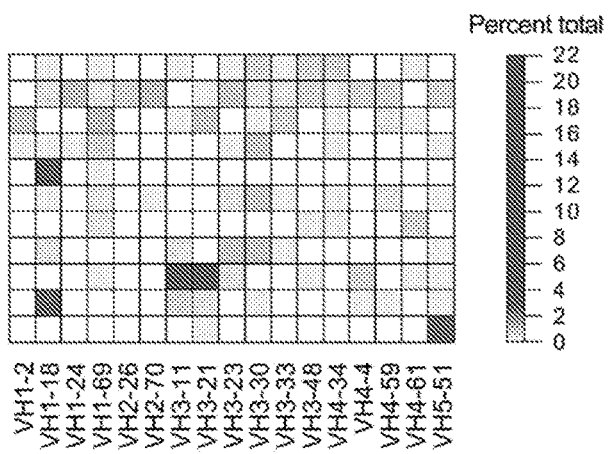

In total, over 450 cognate VH and VL pairs were cloned and expressed as full-length IgGs in an engineered strain of *Saccharomyces cerevisiae* (Bornholdt et al., 2016; Swers et al., 2004). As expected, sequence analysis showed that the median level of SHM in class-switched B cells increased as a function of age (FIG. 2D). Also, the majority of antibodies isolated from infants <3 mo. lacked SHM, similar to what was observed previously in postF-reactive B cells (Williams et al., 2009). However, nearly 5% of antibodies isolated from these infants had VH genes containing at least five nucleotide substitutions, consistent with previous studies showing that SHM does occur in young infants, albeit at relatively low frequency (Rechavi et al., 2015; Ridings et al., 1998). The level of SHM in antibodies isolated from the two infants ≥6 mo. was relatively high, with a median of 7 and 13 $V_H$ nucleotide substitutions resulting in a median of 6 and 11 amino acid substitutions, respectively (FIG. 2D). Analysis of VH and VL germline gene usage showed that RSV F-reactive infant antibody responses were strongly biased toward either VH3-21/VL1-40 or the highly related VH3-11/VL1-40 gene pairing (FIG. 2E). There was also a more modest preference for the VH1-18/VK2-30, VH1-18/VL3-21, and VH5-51/VL6-57 gene pairs (FIG. 2E). The VH1-18/VK2-30 gene pair was present in 8.5% of RSV F-reactive antibodies isolated from adults and is associated with recognition of site V on prefusion F (Gilman et al., 2016; Mousa et al., 2017). Overall, the results demonstrate that RSV infection induced B cell responses with higher levels of SHM in infants ≥6 mo. compared to <3 mo., and that the responses in both age groups exhibit biased germline gene usage.

Figure 3A:
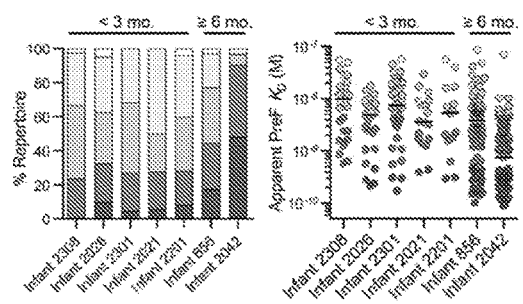
FIGS. 3A-3D show that a subset of RSV F-specific infant antibodies binds with high affinity to RSV F and neutralizes RSV. The fraction of isolated antibodies from each infant that binds with weak, low, medium, or high apparent affinity for preF (FIG. 3A) or postF (FIG. 3B) is shown for each antibody that displayed detectable binding in this assay. Infants are ordered from youngest to oldest, left to right. Apparent binding affinities are shown for each antibody. Black bars indicate medians. N.D., not determined. The percentage of antibodies isolated from each infant that shows weak, low, medium, or high neutralization potency is shown (FIG. 3C). Neutralization $IC_{50}$ values are shown for each antibody with measurable neutralization activity. Top, middle, and bottom dotted lines show $IC_{50}$ values for motavizumab, MPE8, and D25, respectively. Black bars indicate medians.
Figure 3B:
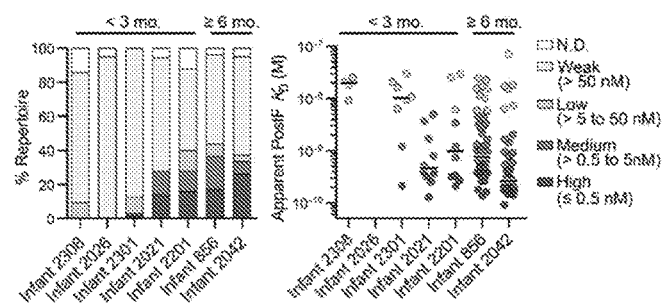
Figure 4A:
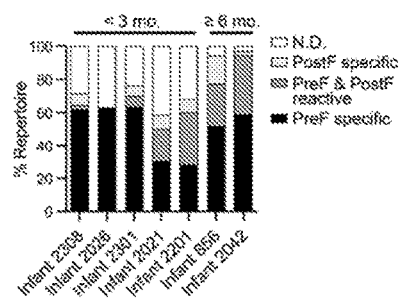
FIGS. 4A-4C show that RSV-neutralizing, F-conformation-independent antibodies are rare in young infants. The percentage of antibodies that are preF-specific (black), preF- and postF-reactive (grey), or postF-specific (light grey) is shown for each infant (FIG. 4A). N.D., not-determined (white). Infants are ordered from youngest to oldest, left to right. The percentage of antibodies with high, medium, low, or weak neutralization potency is plotted for each group in infants <3 mo. (left panel) and ≥6 mo. (right panel) (FIG. 4B). Neutralization $IC_{50}$s are shown for antibodies in each group that displayed measurable neutralization activity (FIG. 4C). Black bars indicate medians.

A Subset of Infant Antibodies Binds with High Affinity to RSV F and Potently Neutralizes RSV To further characterize the infant antibodies, the apparent binding affinity of each antibody for preF and postF was determined. For each of the infants <3 mo., 24-34% of the isolated antibodies bound to preF with an apparent affinity of ≤5 nM, compared with 45% and 91% for the two infants ≥6 mo. (FIG. 3A). Although a total of 40 such antibodies were isolated from the youngest three infants, only two antibodies with ≤5 nM affinity for postF were isolated from the same three infants (FIG. 3B). In addition, for every infant the number of antibodies with ≤5 nM affinity for postF was lower than those with ≤5 nM affinity for preF (FIG. 3B). Consistent with this result, the percentage of preF-specific antibodies ranged from 28-63%, whereas substantially smaller percentages (2-17%) were postF-specific (FIG. 4A). Antibodies recognizing both preF and postF comprised about 19-36% of the antibody responses in the four oldest infants, but less than 10% of the response in the three youngest infants. Collectively, these results suggest that young infants generate a preF-biased antibody response that expands to include recognition of postF by six months of age.

Figure 3C:
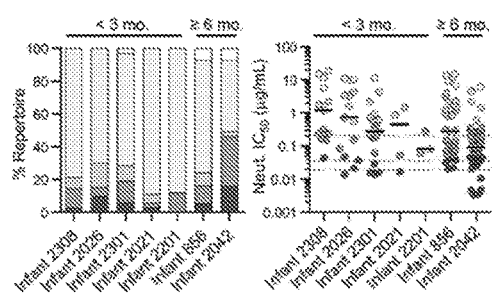

Next, the antibodies were tested for neutralizing activity using a high-throughput assay. This analysis revealed that 12-49% of the antibodies isolated from each infant showed neutralizing activity, and a subset of antibodies isolated from six out of the seven infants showed highly potent neutralizing activity ($IC_{50}$s<0.05 µg/ml) (FIG. 3C). Interestingly, nearly 20% of the neutralizing antibodies lacked VH and VL gene mutations (Table 2), suggesting that extensive affinity maturation is not required for potent neutralization of RSV. The name, donor ID number, sequence information, binding affinity, neutralization $IC_{50}$, epitope and index sort information for each antibody is shown in the table.

TABLE 2

Summary of antibody characteristics

| Name | Donor | Prefusion subtype A $K_d$ (M)* | Postfusion subtype A $K_d$ (M)* | Prefusion subtype B $K_d$ (M)* | Postfusion subtype B $K_d$ (M)* | Neut IC$_{50}$ (ug/ml) subtype A* | Neut IC$_{50}$ (ug/ml) subtype B* |
|---|---|---|---|---|---|---|---|
| ADI-25462 | Infant 2308 | 6.42E−10 | N.B. | 1.71E−09 | N.B. | 0.15 | 0.11 |
| ADI-25467 | Infant 2308 | N.B. | 2.53E−08 | N.B. | 2.62E−08 | N.N. | N.N. |
| ADI-25468 | Infant 2308 | 2.89E−08 | N.B. | N.B. | N.B. | N.N. | N.N. |
| ADI-25472 | Infant 2308 | 1.19E−08 | N.B. | 3.77E−08 | N.B. | N.N. | N.N. |
| ADI-25478 | Infant 2308 | 2.43E−09 | N.B. | 6.43E−09 | N.B. | 2.18 | 3.52 |
| ADI-25479 | Infant 2308 | 1.57E−09 | N.B. | 4.29E−09 | N.B. | 0.24 | 0.29 |
| ADI-25480 | Infant 2308 | 1.27E−09 | N.B. | 4.27E−09 | N.B. | 0.17 | 0.17 |
| ADI-25484 | Infant 2308 | 3.79E−09 | N.B. | 1.84E−08 | N.B. | 15.28 | 8.58 |
| ADI-25491 | Infant 2308 | 3.74E−08 | P.F. | 2.19E−08 | N.B. | N.N. | N.N. |
| ADI-25495 | Infant 2308 | 8.70E−10 | N.B. | 6.41E−09 | N.B. | 0.24 | 5.60 |
| ADI-25496 | Infant 2308 | 2.08E−08 | N.B. | N.B. | N.B. | N.N. | N.N. |
| ADI-25497 | Infant 2308 | 5.00E−08 | 1.84E−08 | 1.41E−08 | 1.48E−08 | N.N. | N.N. |
| ADI-25502 | Infant 2308 | 2.93E−08 | P.F. | N.B. | N.B. | N.N. | N.N. |
| ADI-25503 | Infant 2308 | 7.02E−09 | N.B. | N.B. | N.B. | N.N. | N.N. |
| ADI-25505 | Infant 2308 | P.F. | N.B. | N.B. | N.B. | N.N. | N.N. |
| ADI-25514 | Infant 2308 | 4.45E−09 | N.B. | N.B. | N.B. | N.N. | N.N. |
| ADI-25517 | Infant 2308 | N.B. | P.F. | N.B. | N.B. | N.N. | N.N. |
| ADI-25518 | Infant 2308 | 5.57E−08 | P.F. | 3.95E−08 | N.B. | N.N. | N.N. |
| ADI-25524 | Infant 2308 | 8.38E−09 | N.B. | 2.34E−08 | N.B. | 1.77 | 2.09 |
| ADI-25532 | Infant 2308 | 5.87E−10 | N.B. | 1.56E−09 | N.B. | 0.04 | 0.05 |
| ADI-25533 | Infant 2308 | N.B. | P.F. | N.B. | N.B. | N.N. | N.N. |
| ADI-25542 | Infant 2308 | 9.05E−09 | N.B. | N.B. | N.B. | N.N. | N.N. |
| ADI-25547 | Infant 2308 | N.B. | 2.15E−08 | 2.03E−08 | 2.31E−08 | N.N. | N.N. |
| ADI-25548 | Infant 2308 | 1.71E−08 | N.B. | N.B. | N.B. | N.N. | N.N. |
| ADI-25549 | Infant 2308 | 6.72E−09 | N.B. | 2.88E−08 | N.B. | 11.47 | 6.02 |
| ADI-25555 | Infant 2308 | 1.11E−08 | N.B. | 4.47E−08 | N.B. | 18.59 | 12.08 |
| ADI-25556 | Infant 2308 | 1.19E−08 | N.B. | 4.20E−08 | N.B. | N.N. | N.N. |
| ADI-25557 | Infant 2308 | 8.29E−09 | N.B. | 3.33E−08 | N.B. | N.N. | N.N. |
| ADI-25559 | Infant 2308 | 1.27E−08 | N.B. | 3.33E−08 | N.B. | N.N. | N.N. |
| ADI-25562 | Infant 2308 | 1.69E−09 | N.B. | 3.32E−09 | N.B. | 1.18 | 1.14 |
| ADI-25565 | Infant 2308 | 1.54E−08 | N.B. | 3.57E−08 | N.B. | N.N. | N.N. |
| ADI-25567 | Infant 2308 | 2.40E−08 | N.B. | 3.83E−09 | N.B. | 0.33 | 1.94 |
| ADI-25569 | Infant 2308 | N.B. | P.F. | P.F. | P.F. | N.N. | N.N. |
| ADI-25572 | Infant 2308 | N.B. | N.B. | P.F. | P.F. | N.N. | N.N. |
| ADI-25573 | Infant 2308 | N.B. | N.B. | N.B. | 4.86E−08 | N.N. | N.N. |
| ADI-25575 | Infant 2308 | N.B. | N.B. | N.B. | 3.96E−08 | 5.64 | N.N. |
| ADI-25576 | Infant 2308 | N.B. | N.B. | N.B. | 2.39E−08 | N.N. | N.N. |
| ADI-25577 | Infant 2308 | 1.40E−08 | N.B. | 4.42E−08 | N.B. | N.N. | N.N. |
| ADI-25587 | Infant 2308 | N.B. | 9.23E−09 | N.B. | 7.93E−09 | N.N. | N.N. |
| ADI-25588 | Infant 2308 | 1.73E−08 | N.B. | N.B. | N.B. | N.N. | N.N. |
| ADI-25595 | Infant 2308 | 1.27E−08 | N.B. | N.B. | N.B. | N.N. | N.N. |
| ADI-25598 | Infant 2308 | N.B. | N.B. | N.B. | P.F. | N.N. | N.N. |
| ADI-19420 | Infant 2026 | 5.70E−10 | N.B. | 2.47E−09 | N.B. | 0.55 | 0.64 |
| ADI-19421 | Infant 2026 | 7.22E−09 | N.B. | 5.42E−09 | N.B. | 10.00 | 3.30 |
| ADI-19422 | Infant 2026 | 2.23E−09 | N.B. | 1.08E−08 | N.B. | 0.73 | 1.90 |
| ADI-19424 | Infant 2026 | 1.07E−09 | N.B. | 1.71E−09 | N.B. | 0.08 | 0.21 |
| ADI-19425 | Infant 2026 | 4.56E−10 | N.B. | 1.37E−09 | N.B. | 0.02 | 0.04 |
| ADI-19426 | Infant 2026 | 2.87E−09 | N.B. | 1.29E−08 | N.B. | N.N. | N.N. |
| ADI-19427 | Infant 2026 | 2.78E−10 | N.B. | 5.00E−10 | N.B. | 0.01 | 0.03 |
| ADI-19428 | Infant 2026 | 4.96E−09 | N.B. | 1.67E−08 | N.B. | 3.25 | N.N. |
| ADI-19429 | Infant 2026 | 1.23E−08 | N.B. | N.B. | N.B. | N.N. | N.N. |
| ADI-19430 | Infant 2026 | 5.02E−09 | N.B. | 1.68E−08 | N.B. | N.N. | N.N. |
| ADI-19431 | Infant 2026 | 8.18E−09 | N.B. | 3.16E−09 | N.B. | 4.35 | 0.17 |
| ADI-19432 | Infant 2026 | P.F. | N.B. | N.B. | N.B. | 10.98 | N.N. |
| ADI-19433 | Infant 2026 | 3.60E−09 | N.B. | N.B. | N.B. | 1.56 | N.N. |
| ADI-19435 | Infant 2026 | N.B. | N.B. | N.B. | N.B. | N.N. | N.N. |
| ADI-19436 | Infant 2026 | N.B. | N.B. | N.B. | N.B. | N.N. | N.N. |
| ADI-19437 | Infant 2026 | N.B. | P.F. | N.B. | N.B. | N.N. | N.N. |
| ADI-19439 | Infant 2026 | N.B. | N.B. | N.B. | N.B. | N.N. | N.N. |
| ADI-19440 | Infant 2026 | 5.41E−09 | N.B. | 1.43E−08 | N.B. | N.N. | N.N. |
| ADI-19441 | Infant 2026 | N.B. | N.B. | N.B. | N.B. | N.N. | N.N. |
| ADI-19444 | Infant 2026 | N.B. | N.B. | N.B. | N.B. | N.N. | N.N. |
| ADI-19445 | Infant 2026 | N.B. | N.B. | N.B. | P.F. | N.N. | N.N. |
| ADI-19447 | Infant 2026 | P.F. | N.B. | N.B. | N.B. | N.N. | N.N. |
| ADI-19448 | Infant 2026 | 6.08E−09 | N.B. | 5.58E−09 | N.B. | 9.64 | N.N. |
| ADI-19449 | Infant 2026 | 1.48E−08 | N.B. | 2.60E−08 | N.B. | N.N. | N.N. |
| ADI-19450 | Infant 2026 | N.B. | N.B. | 3.86E−08 | N.B. | N.N. | N.N. |
| ADI-19454 | Infant 2026 | 2.52E−09 | N.B. | 1.57E−08 | N.B. | N.N. | N.N. |
| ADI-19455 | Infant 2026 | 1.80E−08 | N.B. | N.B. | N.B. | N.N. | N.N. |
| ADI-19457 | Infant 2026 | 8.29E−09 | N.B. | 1.67E−08 | N.B. | N.N. | N.N. |
| ADI-19458 | Infant 2026 | 2.15E−10 | N.B. | 2.43E−10 | N.B. | 0.04 | 0.07 |
| ADI-19459 | Infant 2026 | 1.09E−09 | N.B. | 1.45E−09 | N.B. | 0.05 | 0.10 |
| ADI-19460 | Infant 2026 | 7.50E−09 | N.B. | 6.01E−09 | N.B. | N.N. | N.N. |
| ADI-19461 | Infant 2026 | N.B. | N.B. | P.F. | N.B. | N.N. | N.N. |

TABLE 2-continued

Summary of antibody characteristics

| | | | | | | | |
|---|---|---|---|---|---|---|---|
| ADI-19462 | Infant 2026 | N.B. | P.F. | N.B. | N.B. | N.N. | N.N. |
| ADI-19463 | Infant 2026 | N.B. | N.B. | N.B. | N.B. | N.N. | N.N. |
| ADI-19465 | Infant 2026 | 2.74E−09 | N.B. | 1.94E−08 | N.B. | N.N. | N.N. |
| ADI-19506 | Infant 2026 | N.B. | N.B. | N.B. | N.B. | N.N. | N.N. |
| ADI-19507 | Infant 2026 | 1.09E−08 | N.B. | 1.01E−08 | N.B. | N.N. | N.N. |
| ADI-19509 | Infant 2026 | 9.33E−09 | N.B. | 1.58E−08 | N.B. | 3.42 | 1.56 |
| ADI-19510 | Infant 2026 | 2.38E−10 | N.B. | 2.39E−10 | N.B. | 0.16 | 0.83 |
| ADI-19511 | Infant 2026 | N.B. | N.B. | N.B. | 1.53E−08 | N.N. | N.N. |
| ADI-24792 | Infant 2301 | 6.52E−10 | N.B. | 1.83E−09 | N.B. | 0.27 | 0.19 |
| ADI-24793 | Infant 2301 | N.B. | N.B. | N.B. | 2.68E−08 | N.N. | N.N. |
| ADI-24795 | Infant 2301 | 2.39E−08 | N.B. | 3.42E−08 | N.B. | N.N. | N.N. |
| ADI-24796 | Infant 2301 | N.B. | N.B. | 8.22E−08 | N.B. | N.N. | N.N. |
| ADI-24798 | Infant 2301 | 9.92E−09 | N.B. | 5.27E−09 | N.B. | N.N. | N.N. |
| ADI-24799 | Infant 2301 | 1.22E−08 | N.B. | 1.90E−08 | N.B. | 11.53 | N.N. |
| ADI-24800 | Infant 2301 | 2.83E−08 | N.B. | 5.14E−08 | N.B. | N.N. | N.N. |
| ADI-24801 | Infant 2301 | 5.89E−08 | N.B. | N.B. | N.B. | N.N. | N.N. |
| ADI-24803 | Infant 2301 | N.B. | 1.20E−09 | N.B. | 4.42E−10 | N.N. | N.N. |
| ADI-24805 | Infant 2301 | 3.79E−09 | N.B. | 4.88E−09 | N.B. | 0.21 | 0.71 |
| ADI-24807 | Infant 2301 | N.B. | 1.64E−08 | N.B. | N.B. | N.N. | N.N. |
| ADI-24808 | Infant 2301 | N.B. | 1.08E−08 | N.B. | N.B. | N.N. | N.N. |
| ADI-24811 | Infant 2301 | 8.10E−09 | N.B. | 4.29E−09 | N.B. | N.N. | N.N. |
| ADI-24812 | Infant 2301 | 3.51E−09 | N.B. | 7.58E−09 | N.B. | 0.18 | N.N. |
| ADI-24813 | Infant 2301 | N.B. | N.B. | N.B. | N.B. | N.N. | N.N. |
| ADI-24814 | Infant 2301 | 8.11E−09 | N.B. | 2.39E−09 | N.B. | 0.73 | 0.32 |
| ADI-24815 | Infant 2301 | 1.84E−08 | N.B. | 2.91E−08 | N.B. | N.N. | N.N. |
| ADI-24816 | Infant 2301 | N.B. | N.B. | N.B. | N.B. | N.N. | N.N. |
| ADI-24817 | Infant 2301 | 6.80E−09 | N.B. | 9.23E−09 | N.B. | 2.20 | 4.40 |
| ADI-24818 | Infant 2301 | 3.36E−08 | 6.47E−09 | N.B. | N.B. | N.N. | N.N. |
| ADI-24819 | Infant 2301 | 6.52E−09 | N.B. | 9.44E−09 | N.B. | 4.33 | 6.28 |
| ADI-24820 | Infant 2301 | 3.06E−08 | N.B. | 3.85E−08 | N.B. | N.N. | N.N. |
| ADI-24821 | Infant 2301 | N.B. | N.B. | N.B. | N.B. | N.N. | N.N. |
| ADI-24822 | Infant 2301 | 4.65E−08 | N.B. | N.B. | N.B. | N.N. | N.N. |
| ADI-24823 | Infant 2301 | 4.16E−09 | N.B. | 6.03E−09 | N.B. | ND | ND |
| ADI-24824 | Infant 2301 | 1.51E−08 | N.B. | 4.75E−08 | N.B. | N.N. | N.N. |
| ADI-24825 | Infant 2301 | 3.31E−08 | 3.01E−08 | N.B. | 2.60E−08 | N.N. | N.N. |
| ADI-24826 | Infant 2301 | 6.88E−09 | N.B. | 9.03E−09 | N.B. | N.N. | N.N. |
| ADI-24827 | Infant 2301 | 7.42E−09 | N.B. | 6.62E−09 | N.B. | 0.02 | N.N. |
| ADI-24828 | Infant 2301 | 3.06E−10 | N.B. | 3.91E−10 | N.B. | 0.02 | 0.04 |
| ADI-24829 | Infant 2301 | N.B. | N.B. | N.B. | N.B. | N.N. | N.N. |
| ADI-24830 | Infant 2301 | N.B. | N.B. | N.B. | N.B. | N.N. | N.N. |
| ADI-24831 | Infant 2301 | 4.88E−09 | N.B. | 6.23E−09 | N.B. | 0.21 | 3.29 |
| ADI-24832 | Infant 2301 | 1.80E−09 | N.B. | 1.95E−09 | N.B. | 0.49 | 0.24 |
| ADI-24833 | Infant 2301 | 1.93E−08 | N.B. | 1.14E−08 | N.B. | N.N. | N.N. |
| ADI-24834 | Infant 2301 | 1.12E−09 | 2.11E−10 | 7.32E−10 | 2.60E−10 | N.N. | N.N. |
| ADI-24835 | Infant 2301 | 4.93E−09 | N.B. | 5.55E−09 | N.B. | 0.63 | 1.06 |
| ADI-24836 | Infant 2301 | 2.87E−09 | N.B. | 3.44E−09 | N.B. | N.N. | N.N. |
| ADI-24837 | Infant 2301 | 2.75E−08 | N.B. | N.B. | N.B. | N.N. | N.N. |
| ADI-24838 | Infant 2301 | N.B. | N.B. | N.B. | N.B. | N.N. | N.N. |
| ADI-24839 | Infant 2301 | 5.83E−09 | N.B. | 9.63E−09 | N.B. | 0.44 | 4.10 |
| ADI-24840 | Infant 2301 | 7.32E−09 | N.B. | 7.80E−09 | N.B. | N.N. | N.N. |
| ADI-24841 | Infant 2301 | N.B. | N.B. | 2.66E−08 | N.B. | N.N. | N.N. |
| ADI-24842 | Infant 2301 | 5.59E−10 | N.B. | 2.76E−09 | N.B. | 0.03 | 0.03 |
| ADI-24843 | Infant 2301 | N.B. | N.B. | N.B. | N.B. | N.N. | N.N. |
| ADI-24845 | Infant 2301 | 1.19E−08 | N.B. | 3.67E−08 | N.B. | N.N. | N.N. |
| ADI-24846 | Infant 2301 | N.B. | N.B. | N.B. | 2.91E−08 | N.N. | N.N. |
| ADI-24847 | Infant 2301 | N.B. | N.B. | 4.00E−08 | N.B. | N.N. | N.N. |
| ADI-24848 | Infant 2301 | 2.08E−08 | N.B. | 3.56E−08 | N.B. | N.N. | N.N. |
| ADI-24849 | Infant 2301 | 1.71E−10 | N.B. | 1.17E−09 | N.B. | 0.01 | 0.03 |
| ADI-24850 | Infant 2301 | 3.84E−09 | N.B. | 5.56E−09 | N.B. | 0.94 | 4.17 |
| ADI-24851 | Infant 2301 | N.B. | 2.09E−08 | N.B. | N.B. | N.N. | N.N. |
| ADI-24852 | Infant 2301 | 1.18E−08 | 9.57E−09 | 1.90E−08 | 9.17E−09 | N.N. | N.N. |
| ADI-24854 | Infant 2301 | N.B. | N.B. | 3.03E−08 | N.B. | N.N. | N.N. |
| ADI-24855 | Infant 2301 | 1.79E−08 | N.B. | 2.80E−08 | N.B. | N.N. | N.N. |
| ADI-24856 | Infant 2301 | 1.35E−08 | N.B. | 4.91E−09 | N.B. | N.N. | N.N. |
| ADI-24857 | Infant 2301 | 3.20E−09 | N.B. | 3.71E−09 | N.B. | 0.18 | 1.40 |
| ADI-24858 | Infant 2301 | 2.16E−08 | N.B. | 2.63E−08 | N.B. | N.N. | N.N. |
| ADI-24859 | Infant 2301 | 4.31E−09 | N.B. | 4.95E−09 | N.B. | 0.58 | N.N. |
| ADI-24860 | Infant 2301 | 1.08E−09 | N.B. | 1.56E−09 | N.B. | 0.06 | 0.09 |
| ADI-24861 | Infant 2301 | 3.01E−10 | N.B. | 4.61E−10 | N.B. | N.N. | N.N. |
| ADI-24862 | Infant 2301 | N.B. | N.B. | N.B. | N.B. | N.N. | N.N. |
| ADI-24863 | Infant 2301 | N.B. | N.B. | N.B. | N.B. | N.N. | N.N. |
| ADI-19467 | Infant 2021 | 9.13E−09 | N.B. | 3.77E−08 | N.B. | N.N. | N.N. |
| ADI-19468 | Infant 2021 | 2.22E−09 | N.B. | N.B. | N.B. | N.N. | N.N. |
| ADI-19469 | Infant 2021 | 1.74E−08 | N.B. | N.B. | N.B. | N.N. | N.N. |
| ADI-19470 | Infant 2021 | 2.97E−08 | N.B. | 1.97E−08 | N.B. | N.N. | N.N. |
| ADI-19471 | Infant 2021 | 3.23E−09 | N.B. | N.B. | N.B. | N.N. | N.N. |
| ADI-19473 | Infant 2021 | N.B. | N.B. | N.B. | N.B. | N.N. | N.N. |
| ADI-19474 | Infant 2021 | N.B. | N.B. | N.B. | N.B. | N.N. | N.N. |

TABLE 2-continued

Summary of antibody characteristics

| | | | | | | | |
|---|---|---|---|---|---|---|---|
| ADI-19475 | Infant 2021 | 1.43E−09 | N.B. | 4.25E−09 | N.B. | 0.05 | 0.04 |
| ADI-19476 | Infant 2021 | N.B. | 8.01E−10 | N.B. | 8.38E−10 | N.N. | N.N. |
| ADI-19478 | Infant 2021 | N.B. | 3.86E−10 | N.B. | 7.13E−10 | N.N. | N.N. |
| ADI-19479 | Infant 2021 | N.B. | 3.69E−09 | N.B. | 2.69E−09 | N.N. | N.N. |
| ADI-19480 | Infant 2021 | 3.95E−10 | 1.29E−10 | 3.83E−10 | 1.19E−10 | N.N. | 6.25 |
| ADI-19481 | Infant 2021 | 7.60E−09 | N.B. | N.B. | N.B. | N.N. | N.N. |
| ADI-19482 | Infant 2021 | 1.28E−09 | 1.71E−09 | 1.89E−09 | 5.55E−10 | 1.49 | 2.24 |
| ADI-19483 | Infant 2021 | 1.72E−09 | 3.21E−10 | 1.77E−09 | 1.53E−10 | N.N. | N.N. |
| ADI-19484 | Infant 2021 | 1.75E−09 | 3.69E−10 | 8.92E−09 | 3.55E−10 | N.N. | N.N. |
| ADI-19485 | Infant 2021 | 3.56E−09 | 2.51E−10 | N.B. | P.F. | N.N. | N.N. |
| ADI-19486 | Infant 2021 | 3.71E−09 | 5.25E−10 | N.B. | 7.55E−09 | N.N. | N.N. |
| ADI-19487 | Infant 2021 | N.B. | N.B. | N.B. | N.B. | N.N. | 7.96 |
| ADI-19488 | Infant 2021 | 9.02E−09 | N.B. | 1.07E−08 | N.B. | N.N. | 3.38 |
| ADI-19489 | Infant 2021 | N.B. | N.B. | N.B. | N.B. | N.N. | N.N. |
| ADI-19490 | Infant 2021 | N.B. | N.B. | N.B. | N.B. | N.N. | N.N. |
| ADI-19491 | Infant 2021 | N.B. | N.B. | N.B. | N.B. | N.N. | N.N. |
| ADI-19492 | Infant 2021 | N.B. | N.B. | N.B. | N.B. | N.N. | N.N. |
| ADI-19493 | Infant 2021 | 7.93E−09 | N.B. | 2.26E−08 | N.B. | N.N. | N.N. |
| ADI-19494 | Infant 2021 | 5.48E−09 | N.B. | N.B. | N.B. | 0.86 | N.N. |
| ADI-19495 | Infant 2021 | N.B. | N.B. | N.B. | N.B. | N.N. | N.N. |
| ADI-19496 | Infant 2021 | N.B. | N.B. | N.B. | N.B. | N.N. | N.N. |
| ADI-19497 | Infant 2021 | N.B. | P.F. | N.B. | 1.34E−08 | N.N. | N.N. |
| ADI-19498 | Infant 2021 | N.B. | P.F. | N.B. | P.F. | N.N. | N.N. |
| ADI-19499 | Infant 2021 | N.B. | N.B. | N.B. | N.B. | N.N. | N.N. |
| ADI-19500 | Infant 2021 | N.B. | N.B. | N.B. | N.B. | N.N. | N.N. |
| ADI-19501 | Infant 2021 | 4.46E−10 | N.B. | 1.59E−09 | N.B. | 0.02 | 0.02 |
| ADI-19502 | Infant 2021 | N.B. | N.B. | N.B. | N.B. | N.N. | N.N. |
| ADI-19503 | Infant 2021 | N.B. | N.B. | N.B. | 1.16E−08 | N.N. | N.N. |
| ADI-19505 | Infant 2021 | 1.33E−08 | 4.94E−09 | 4.44E−08 | 5.01E−09 | N.N. | N.N. |
| ADI-22756 | Infant 2201 | 7.85E−09 | N.B. | 5.58E−08 | N.B. | N.N. | N.N. |
| ADI-22757 | Infant 2201 | 3.10E−10 | N.B. | 5.38E−10 | N.B. | 0.06 | 0.07 |
| ADI-22758 | Infant 2201 | 6.32E−09 | N.B. | P.F. | N.B. | N.N. | N.N. |
| ADI-22759 | Infant 2201 | 2.97E−10 | 2.53E−08 | 3.53E−10 | 1.01E−08 | 0.08 | 0.20 |
| ADI-22760 | Infant 2201 | 5.21E−09 | 1.19E−09 | 3.07E−09 | 1.25E−09 | N.N. | N.N. |
| ADI-22762 | Infant 2201 | 5.76E−08 | P.F. | N.B. | N.B. | N.N. | N.N. |
| ADI-22763 | Infant 2201 | 1.58E−09 | 3.19E−10 | 1.08E−08 | 5.33E−09 | N.N. | N.N. |
| ADI-22764 | Infant 2201 | 2.27E−09 | 3.34E−10 | 1.42E−09 | 1.44E−09 | N.N. | N.N. |
| ADI-22765 | Infant 2201 | 4.04E−08 | N.B. | P.F. | N.B. | N.N. | N.N. |
| ADI-22766 | Infant 2201 | N.B. | N.B. | N.B. | N.B. | N.N. | N.N. |
| ADI-22767 | Infant 2201 | 1.71E−08 | N.B. | P.F. | N.B. | N.N. | N.N. |
| ADI-22768 | Infant 2201 | 5.61E−09 | 3.41E−09 | 4.57E−09 | N.B. | N.N. | N.N. |
| ADI-22769 | Infant 2201 | N.B. | N.B. | N.B. | P.F. | N.N. | N.N. |
| ADI-22770 | Infant 2201 | N.B. | P.F. | N.B. | P.F. | N.N. | N.N. |
| ADI-22771 | Infant 2201 | 7.06E−09 | N.B. | 9.41E−09 | N.B. | N.N. | N.N. |
| ADI-22772 | Infant 2201 | N.B. | N.B. | N.B. | 5.02E−08 | N.N. | N.N. |
| ADI-22773 | Infant 2201 | P.F. | N.B. | N.B. | N.B. | N.N. | N.N. |
| ADI-22774 | Infant 2201 | 2.06E−09 | N.B. | 4.28E−09 | N.B. | 0.29 | 7.53 |
| ADI-22775 | Infant 2201 | N.B. | 3.00E−08 | N.B. | P.F. | N.N. | N.N. |
| ADI-22776 | Infant 2201 | N.B. | N.B. | P.F. | N.B. | N.N. | N.N. |
| ADI-22777 | Infant 2201 | 1.80E−09 | 2.68E−10 | 7.62E−10 | 2.24E−10 | N.N. | N.N. |
| ADI-22778 | Infant 2201 | 6.22E−10 | 2.09E−10 | 4.02E−09 | 2.77E−09 | N.N. | N.N. |
| ADI-22779 | Infant 2201 | 1.60E−08 | 6.20E−09 | N.B. | N.B. | N.N. | N.N. |
| ADI-22780 | Infant 2201 | N.B. | 7.39E−10 | 2.38E−08 | 6.00E−10 | N.N. | N.N. |
| ADI-22781 | Infant 2201 | N.B. | P.F. | P.F. | P.F. | N.N. | N.N. |
| ADI-14333 | Infant 856 | 3.53E−10 | N.B. | 9.04E−10 | N.B. | 0.07 | 0.09 |
| ADI-14334 | Infant 856 | 3.16E−10 | N.B. | 6.22E−10 | N.B. | 0.05 | 0.11 |
| ADI-14335 | Infant 856 | 1.96E−10 | N.B. | 8.89E−10 | N.B. | 0.32 | 0.10 |
| ADI-14336 | Infant 856 | 3.12E−10 | N.B. | 2.65E−09 | N.B. | 0.07 | 0.09 |
| ADI-14337 | Infant 856 | 1.39E−09 | N.B. | 2.11E−09 | N.B. | 0.10 | 0.07 |
| ADI-14338 | Infant 856 | 8.41E−09 | 5.98E−09 | 7.04E−09 | 3.14E−09 | N.N. | 10.16 |
| ADI-14339 | Infant 856 | 2.45E−08 | 4.39E−10 | 1.77E−09 | 3.76E−10 | N.N. | N.N. |
| ADI-14340 | Infant 856 | 4.11E−10 | N.B. | 9.80E−08 | N.B. | 6.63 | 1.94 |
| ADI-14341 | Infant 856 | N.B. | 7.13E−10 | N.B. | 6.12E−10 | N.N. | 17.46 |
| ADI-14342 | Infant 856 | 1.57E−09 | 4.95E−10 | 2.61E−08 | P.F. | 1.75 | 8.27 |
| ADI-14343 | Infant 856 | 1.85E−08 | 2.94E−09 | 3.81E−08 | P.F. | N.N. | N.N. |
| ADI-14344 | Infant 856 | 1.81E−10 | N.B. | 5.86E−10 | N.B. | 8.68 | 1.20 |
| ADI-14345 | Infant 856 | 6.32E−09 | N.B. | 5.26E−09 | N.B. | 2.30 | 0.87 |
| ADI-14346 | Infant 856 | 3.09E−10 | N.B. | 9.25E−10 | N.B. | 0.05 | 0.07 |
| ADI-14347 | Infant 856 | 4.99E−10 | N.B. | 2.54E−09 | N.B. | 0.11 | 0.05 |
| ADI-14348 | Infant 856 | 1.96E−09 | 5.66E−09 | 1.10E−07 | N.B. | N.N. | N.N. |
| ADI-14349 | Infant 856 | 5.33E−09 | N.B. | 4.07E−09 | N.B. | N.N. | 1.84 |
| ADI-14350 | Infant 856 | 3.73E−09 | 2.64E−10 | 5.74E−10 | 1.48E−10 | N.N. | 4.82 |
| ADI-14351 | Infant 856 | 2.21E−08 | 3.61E−10 | 7.89E−10 | 2.15E−10 | N.N. | N.N. |
| ADI-14352 | Infant 856 | N.B. | 4.48E−10 | 5.54E−09 | 3.83E−10 | N.N. | N.N. |
| ADI-14353 | Infant 856 | 1.40E−08 | 2.60E−10 | 1.26E−08 | P.F. | N.N. | 14.62 |
| ADI-14354 | Infant 856 | 9.98E−09 | 1.04E−09 | 2.53E−08 | 6.63E−09 | N.N. | N.N. |
| ADI-14355 | Infant 856 | 6.60E−09 | 4.80E−10 | 1.25E−09 | 3.70E−10 | N.N. | 4.72 |
| ADI-14356 | Infant 856 | N.B. | 3.90E−09 | 1.30E−08 | 4.98E−09 | N.N. | N.N. |

TABLE 2-continued

Summary of antibody characteristics

| | | | | | | | |
|---|---|---|---|---|---|---|---|
| ADI-14357 | Infant 856 | 1.76E−10 | N.B. | 3.06E−10 | N.B. | 1.24 | 0.88 |
| ADI-14358 | Infant 856 | 5.91E−09 | 6.56E−10 | 6.03E−08 | 2.75E−08 | N.N. | N.N. |
| ADI-14359 | Infant 856 | N.B. | 4.11E−09 | 3.46E−08 | P.F. | N.N. | N.N. |
| ADI-14360 | Infant 856 | N.B. | 5.88E−09 | 2.68E−08 | 9.03E−09 | N.N. | N.N. |
| ADI-14361 | Infant 856 | N.B. | 4.37E−10 | 5.28E−08 | 2.93E−10 | N.N. | N.N. |
| ADI-14362 | Infant 856 | 3.15E−09 | 1.57E−08 | 1.19E−07 | N.B. | N.N. | N.N. |
| ADI-14363 | Infant 856 | 3.54E−09 | N.B. | 5.35E−09 | N.B. | N.N. | N.N. |
| ADI-14364 | Infant 856 | 6.30E−10 | N.B. | 6.16E−08 | N.B. | 0.03 | 2.39 |
| ADI-14365 | Infant 856 | 1.19E−09 | 1.03E−08 | 9.62E−10 | 2.23E−08 | 0.80 | 0.49 |
| ADI-14366 | Infant 856 | 6.14E−09 | N.B. | 1.80E−08 | N.B. | N.N. | N.N. |
| ADI-14367 | Infant 856 | 1.57E−10 | N.B. | 2.69E−10 | N.B. | 3.94 | 0.33 |
| ADI-14368 | Infant 856 | 2.60E−09 | 2.45E−08 | 1.21E−09 | 1.77E−08 | N.N. | 1.10 |
| ADI-14369 | Infant 856 | N.B. | 1.22E−09 | 3.38E−09 | 9.00E−10 | N.N. | N.N. |
| ADI-14370 | Infant 856 | 8.12E−09 | N.B. | 4.18E−09 | N.B. | N.N. | 1.38 |
| ADI-14371 | Infant 856 | N.B. | 1.23E−09 | 8.43E−09 | 1.07E−09 | N.N. | N.N. |
| ADI-14372 | Infant 856 | N.B. | 6.59E−10 | N.B. | 4.43E−09 | N.N. | N.N. |
| ADI-14373 | Infant 856 | 1.96E−09 | 1.06E−09 | 1.59E−08 | N.B. | N.N. | N.N. |
| ADI-14374 | Infant 856 | 4.61E−09 | N.B. | 2.09E−09 | N.B. | N.N. | 0.86 |
| ADI-14375 | Infant 856 | N.B. | 4.77E−10 | 3.21E−09 | 3.31E−09 | N.N. | N.N. |
| ADI-14376 | Infant 856 | P.F. | P.F. | P.F. | P.F. | N.N. | N.N. |
| ADI-14377 | Infant 856 | 6.64E−09 | N.B. | 5.28E−09 | N.B. | N.N. | 2.13 |
| ADI-14378 | Infant 856 | 5.87E−09 | N.B. | 6.10E−09 | N.B. | N.N. | 21.58 |
| ADI-14379 | Infant 856 | N.B. | 3.29E−09 | N.B. | 2.35E−09 | N.N. | N.N. |
| ADI-14380 | Infant 856 | 6.04E−09 | N.B. | 1.08E−08 | N.B. | N.N. | N.N. |
| ADI-14381 | Infant 856 | 2.20E−09 | 7.54E−10 | 3.67E−08 | P.F. | ND | ND |
| ADI-14382 | Infant 856 | N.B. | 8.46E−10 | N.B. | N.B. | N.N. | N.N. |
| ADI-14383 | Infant 856 | N.B. | 4.34E−10 | 1.75E−09 | 2.51E−10 | N.N. | N.N. |
| ADI-14384 | Infant 856 | 3.71E−09 | 4.69E−10 | 4.78E−09 | N.B. | N.N. | N.N. |
| ADI-14385 | Infant 856 | 8.72E−08 | P.F. | P.F. | P.F. | N.N. | N.N. |
| ADI-14386 | Infant 856 | 6.29E−09 | 1.32E−09 | 3.04E−09 | P.F. | N.N. | N.N. |
| ADI-14388 | Infant 856 | 5.58E−09 | N.B. | 5.50E−09 | N.B. | N.N. | 3.07 |
| ADI-14389 | Infant 856 | N.B. | 2.29E−08 | 8.15E−08 | P.F. | N.N. | N.N. |
| ADI-14390 | Infant 856 | N.B. | N.B. | N.B. | N.B. | N.N. | N.N. |
| ADI-14391 | Infant 856 | 6.95E−09 | N.B. | 5.36E−09 | N.B. | N.N. | 22.25 |
| ADI-14392 | Infant 856 | 7.56E−09 | N.B. | 7.25E−08 | N.B. | N.N. | N.N. |
| ADI-14393 | Infant 856 | 3.11E−10 | N.B. | 4.74E−10 | 1.17E−08 | ND | ND |
| ADI-14394 | Infant 856 | 1.15E−08 | N.B. | P.F. | N.B. | N.N. | N.N. |
| ADI-14395 | Infant 856 | 2.49E−08 | N.B. | P.F. | N.B. | N.N. | N.N. |
| ADI-14396 | Infant 856 | N.B. | N.B. | 1.55E−08 | N.B. | N.N. | N.N. |
| ADI-14397 | Infant 856 | 2.85E−08 | N.B. | P.F. | N.B. | N.N. | N.N. |
| ADI-14399 | Infant 856 | 1.89E−10 | N.B. | 3.65E−10 | N.B. | 0.97 | 0.46 |
| ADI-14400 | Infant 856 | 2.90E−10 | N.B. | 4.51E−10 | N.B. | ND | 3.71 |
| ADI-14401 | Infant 856 | 1.19E−09 | N.B. | 2.17E−09 | N.B. | 0.05 | 0.06 |
| ADI-14402 | Infant 856 | 2.79E−10 | N.B. | 4.16E−10 | N.B. | 0.02 | 0.03 |
| ADI-14403 | Infant 856 | 5.09E−10 | N.B. | 6.99E−10 | N.B. | 0.08 | 0.N.N.1 |
| ADI-14404 | Infant 856 | N.B. | 6.27E−10 | N.B. | 4.98E−10 | N.N. | N.N. |
| ADI-14405 | Infant 856 | 1.42E−10 | 1.17E−08 | 2.27E−10 | 3.80E−08 | 0.04 | 0.04 |
| ADI-14406 | Infant 856 | 6.85E−09 | 3.39E−10 | 9.06E−10 | 4.73E−10 | N.N. | N.N. |
| ADI-14407 | Infant 856 | 6.28E−09 | 3.78E−10 | 1.14E−08 | P.F. | N.N. | N.N. |
| ADI-14408 | Infant 856 | 8.53E−09 | 2.14E−09 | 1.28E−08 | P.F. | N.N. | N.N. |
| ADI-14409 | Infant 856 | 1.50E−10 | N.B. | 2.89E−10 | N.B. | 0.29 | 0.23 |
| ADI-14410 | Infant 856 | 3.77E−09 | N.B. | 1.71E−09 | N.B. | 1.22 | 2.64 |
| ADI-14411 | Infant 856 | 6.12E−09 | N.B. | 3.92E−09 | N.B. | 9.27 | 1.96 |
| ADI-14412 | Infant 856 | 5.60E−09 | N.B. | 1.34E−08 | N.B. | N.N. | N.N. |
| ADI-14413 | Infant 856 | 5.45E−09 | N.B. | 2.71E−09 | N.B. | 15.13 | 1.69 |
| ADI-14414 | Infant 856 | 5.00E−09 | N.B. | 3.07E−09 | N.B. | N.N. | N.N. |
| ADI-14415 | Infant 856 | 4.20E−09 | N.B. | 3.51E−09 | N.B. | N.N. | N.N. |
| ADI-14416 | Infant 856 | 2.39E−09 | 1.82E−10 | 3.69E−10 | 1.06E−10 | N.N. | N.N. |
| ADI-14417 | Infant 856 | N.B. | 1.63E−09 | N.B. | 3.99E−09 | ND | ND |
| ADI-14418 | Infant 856 | 1.25E−09 | 4.41E−10 | 1.58E−09 | 2.58E−10 | 0.30 | 0.66 |
| ADI-14419 | Infant 856 | 2.69E−09 | N.B. | N.B. | N.B. | N.N. | N.N. |
| ADI-14420 | Infant 856 | 6.35E−09 | N.B. | 4.32E−09 | N.B. | N.N. | N.N. |
| ADI-14421 | Infant 856 | N.B. | 1.07E−09 | 2.82E−09 | 7.40E−10 | N.N. | N.N. |
| ADI-14422 | Infant 856 | 1.14E−08 | 4.76E−09 | 3.39E−08 | N.B. | N.N. | N.N. |
| ADI-14423 | Infant 856 | 9.65E−09 | N.B. | 3.40E−09 | N.B. | N.N. | N.N. |
| ADI-14424 | Infant 856 | 3.43E−09 | N.B. | 1.90E−09 | N.B. | N.N. | 2.48 |
| ADI-14425 | Infant 856 | 4.81E−08 | 7.42E−10 | 2.03E−08 | 9.34E−09 | N.N. | N.N. |
| ADI-14426 | Infant 856 | 2.38E−08 | 3.96E−10 | 1.92E−08 | P.F. | N.N. | N.N. |
| ADI-14427 | Infant 856 | 2.34E−10 | 3.33E−09 | 1.08E−08 | N.B. | 0.25 | N.N. |
| ADI-14428 | Infant 856 | 4.22E−08 | N.B. | 1.41E−08 | N.B. | N.N. | N.N. |
| ADI-14654 | Infant 856 | 2.04E−09 | N.B. | 7.64E−09 | N.B. | N.N. | N.N. |
| ADI-14655 | Infant 856 | 1.69E−08 | P.F. | 1.40E−08 | P.F. | N.N. | N.N. |
| ADI-14656 | Infant 856 | P.F. | 3.70E−10 | 2.51E−08 | P.F. | N.N. | N.N. |
| ADI-14657 | Infant 856 | 2.84E−09 | N.B. | N.B. | N.B. | N.N. | N.N. |
| ADI-14658 | Infant 856 | N.B. | 1.58E−08 | N.B. | 1.79E−08 | N.N. | N.N. |
| ADI-14659 | Infant 856 | 4.86E−09 | N.B. | 3.71E−09 | N.B. | N.N. | 5.56 |
| ADI-14571 | Infant 856 | 2.91E−09 | N.B. | N.B. | N.B. | N.N. | 3.06 |
| ADI-14572 | Infant 856 | N.B. | 1.70E−08 | P.F. | N.B. | N.N. | N.N. |

TABLE 2-continued

Summary of antibody characteristics

| | | | | | | | |
|---|---|---|---|---|---|---|---|
| ADI-14573 | Infant 856 | N.B. | 3.73E−10 | 2.10E−08 | 3.55E−09 | N.N. | N.N. |
| ADI-14575 | Infant 856 | 1.12E−08 | P.F. | N.B. | N.B. | N.N. | N.N. |
| ADI-14576 | Infant 856 | 6.97E−09 | N.B. | 1.93E−08 | N.B. | 3.11 | 0.77 |
| ADI-14577 | Infant 856 | 4.39E−10 | N.B. | 2.19E−09 | N.B. | 0.04 | 0.05 |
| ADI-14578 | Infant 856 | 3.29E−09 | N.B. | 4.02E−09 | N.B. | N.N. | N.N. |
| ADI-14579 | Infant 856 | 7.54E−09 | P.F. | 3.73E−09 | N.B. | N.N. | N.N. |
| ADI-14580 | Infant 856 | 6.70E−09 | N.B. | 4.54E−09 | N.B. | N.N. | 3.75 |
| ADI-14581 | Infant 856 | N.B. | N.B. | 2.88E−09 | N.B. | N.N. | 6.25 |
| ADI-14582 | Infant 856 | 5.82E−09 | N.B. | 1.81E−09 | N.B. | ND | ND |
| ADI-14583 | Infant 856 | 4.74E−10 | N.B. | 1.59E−09 | N.B. | 0.05 | 0.06 |
| ADI-14584 | Infant 856 | P.F. | N.B. | 4.76E−10 | N.B. | 1.53 | 0.65 |
| ADI-14585 | Infant 856 | 2.72E−10 | N.B. | 4.49E−10 | N.B. | 0.02 | 0.03 |
| ADI-14586 | Infant 856 | 4.52E−10 | N.B. | 6.70E−09 | N.B. | 0.05 | 0.50 |
| ADI-14587 | Infant 856 | 6.09E−10 | N.B. | 8.33E−10 | N.B. | 0.15 | 0.11 |
| ADI-14588 | Infant 856 | 3.24E−09 | N.B. | 1.48E−09 | N.B. | 13.60 | 0.59 |
| ADI-14589 | Infant 856 | 6.48E−09 | 5.96E−10 | 2.82E−08 | 1.54E−08 | N.N. | N.N. |
| ADI-14590 | Infant 856 | 1.32E−08 | 2.68E−09 | 5.99E−09 | 9.67E−10 | N.N. | N.N. |
| ADI-14591 | Infant 856 | 1.87E−10 | N.B. | 5.54E−10 | N.B. | N.N. | 9.36 |
| ADI-14592 | Infant 856 | 2.40E−10 | 1.36E−10 | 3.01E−10 | 9.32E−11 | N.N. | N.N. |
| ADI-14593 | Infant 856 | 2.33E−09 | 1.61E−10 | 3.58E−10 | 1.08E−10 | 2.28 | 4.03 |
| ADI-14594 | Infant 856 | N.B. | 2.57E−10 | 1.82E−08 | 2.14E−10 | N.N. | N.N. |
| ADI-14595 | Infant 856 | 2.19E−09 | 1.30E−09 | 1.60E−08 | 1.44E−08 | ND | ND |
| ADI-14596 | Infant 856 | 1.86E−10 | N.B. | 1.86E−09 | N.B. | N.N. | N.N. |
| ADI-14597 | Infant 856 | 5.26E−09 | N.B. | 1.67E−09 | N.B. | N.N. | 3.05 |
| ADI-14598 | Infant 856 | P.F. | 4.52E−10 | 7.07E−09 | 4.81E−09 | N.N. | N.N. |
| ADI-14599 | Infant 856 | 1.02E−10 | 6.36E−10 | 6.22E−10 | 3.58E−10 | 0.14 | 1.11 |
| ADI-14600 | Infant 856 | 7.58E−10 | N.B. | 9.86E−10 | N.B. | 0.12 | 0.08 |
| ADI-14601 | Infant 856 | 3.79E−09 | N.B. | 1.96E−09 | N.B. | 12.19 | 3.10 |
| ADI-14602 | Infant 856 | 4.73E−09 | N.B. | 8.94E−09 | N.B. | N.N. | 6.53 |
| ADI-14603 | Infant 856 | 8.40E−09 | N.B. | 3.05E−08 | N.B. | N.N. | 2.03 |
| ADI-14604 | Infant 856 | 2.44E−09 | N.B. | 1.53E−09 | N.B. | N.N. | N.N. |
| ADI-14605 | Infant 856 | N.B. | 9.24E−10 | 2.72E−09 | 3.99E−10 | N.N. | N.N. |
| ADI-14606 | Infant 856 | N.B. | 1.28E−09 | N.B. | 6.59E−10 | 0.85 | 0.29 |
| ADI-14607 | Infant 856 | 1.70E−09 | 3.81E−10 | 6.40E−10 | 2.27E−10 | N.N. | 0.13 |
| ADI-20959 | Infant 2042 | 3.37E−10 | N.B. | 4.30E−10 | N.B. | 0.06 | 0.28 |
| ADI-20960 | Infant 2042 | 2.20E−10 | 1.63E−10 | 2.30E−10 | 1.63E−10 | 0.35 | 0.71 |
| ADI-20961 | Infant 2042 | 3.74E−10 | N.B. | 5.04E−10 | N.B. | 0.09 | 0.32 |
| ADI-20962 | Infant 2042 | 2.89E−10 | N.B. | 4.63E−10 | N.B. | 0.07 | 0.15 |
| ADI-20963 | Infant 2042 | 7.91E−10 | 9.09E−11 | 3.14E−09 | 6.14E−10 | N.N. | N.N. |
| ADI-20964 | Infant 2042 | 3.60E−10 | N.B. | 2.49E−09 | N.B. | 0.06 | 0.14 |
| ADI-20965 | Infant 2042 | 1.21E−10 | P.F. | 5.33E−10 | P.F. | 0.32 | 0.64 |
| ADI-20966 | Infant 2042 | 3.06E−10 | N.B. | 8.62E−10 | N.B. | 0.00 | 0.13 |
| ADI-20967 | Infant 2042 | 2.23E−09 | 2.57E−10 | 4.08E−09 | 3.45E−09 | N.N. | N.N. |
| ADI-20968 | Infant 2042 | 1.35E−10 | 1.57E−10 | 1.27E−10 | 1.50E−10 | 0.14 | 0.44 |
| ADI-20969 | Infant 2042 | 3.01E−10 | N.B. | 4.09E−10 | N.B. | 0.12 | 0.27 |
| ADI-20970 | Infant 2042 | 1.83E−09 | N.B. | 2.55E−09 | N.B. | 2.14 | 2.92 |
| ADI-20971 | Infant 2042 | 3.33E−10 | N.B. | 5.44E−10 | N.B. | N.N. | N.N. |
| ADI-20972 | Infant 2042 | 8.88E−10 | 4.01E−10 | 6.06E−10 | 3.48E−09 | N.N. | N.N. |
| ADI-20973 | Infant 2042 | 3.08E−10 | N.B. | 4.17E−10 | N.B. | 0.03 | 0.19 |
| ADI-20974 | Infant 2042 | 2.91E−10 | N.B. | 3.60E−10 | N.B. | 0.00 | 0.09 |
| ADI-20975 | Infant 2042 | 9.20E−11 | 1.46E−10 | 9.58E−11 | 1.29E−10 | 0.05 | 0.49 |
| ADI-20976 | Infant 2042 | 1.86E−09 | 2.63E−10 | 9.55E−10 | 3.04E−10 | N.N. | N.N. |
| ADI-20977 | Infant 2042 | 1.51E−10 | N.B. | P.F. | N.B. | N.N. | N.N. |
| ADI-20978 | Infant 2042 | 2.90E−10 | N.B. | 3.19E−10 | N.B. | 0.01 | 0.17 |
| ADI-20979 | Infant 2042 | 9.79E−10 | N.B. | 4.00E−09 | N.B. | 0.29 | 0.21 |
| ADI-20980 | Infant 2042 | 2.00E−10 | N.B. | 5.42E−10 | N.B. | N.N. | N.N. |
| ADI-20981 | Infant 2042 | 2.34E−09 | 2.33E−10 | 2.14E−09 | 2.95E−10 | N.N. | N.N. |
| ADI-20982 | Infant 2042 | 4.88E−09 | N.B. | 5.45E−09 | N.B. | N.N. | N.N. |
| ADI-20983 | Infant 2042 | 2.13E−10 | 2.05E−09 | 1.17E−09 | P.F. | N.N. | N.N. |
| ADI-20984 | Infant 2042 | 3.29E−09 | N.B. | 2.02E−08 | N.B. | N.N. | N.N. |
| ADI-20986 | Infant 2042 | 4.14E−10 | N.B. | 1.25E−09 | N.B. | 0.02 | 0.19 |
| ADI-20987 | Infant 2042 | 4.63E−09 | N.B. | 3.56E−08 | N.B. | N.N. | N.N. |
| ADI-20988 | Infant 2042 | 2.94E−10 | N.B. | 1.29E−09 | N.B. | 0.06 | 0.27 |
| ADI-20989 | Infant 2042 | 4.80E−09 | 4.28E−10 | 6.29E−09 | 8.09E−10 | N.N. | N.N. |
| ADI-20990 | Infant 2042 | 1.58E−09 | 1.78E−10 | 9.04E−10 | 3.12E−10 | N.N. | N.N. |
| ADI-20991 | Infant 2042 | 2.34E−10 | N.B. | 2.58E−10 | N.B. | 0.14 | 0.19 |
| ADI-20992 | Infant 2042 | 9.56E−10 | N.B. | 1.22E−09 | N.B. | 0.04 | 0.64 |
| ADI-20993 | Infant 2042 | 1.38E−09 | 1.68E−10 | 7.42E−10 | 2.73E−10 | N.N. | N.N. |
| ADI-20994 | Infant 2042 | 8.94E−11 | P.F. | 1.09E−10 | P.F. | 0.06 | 0.18 |
| ADI-20995 | Infant 2042 | 2.60E−09 | N.B | 1.36E−08 | N.B | ND | ND |
| ADI-20996 | Infant 2042 | 1.03E−09 | 2.04E−10 | 1.06E−09 | 1.12E−09 | N.N. | N.N. |
| ADI-20997 | Infant 2042 | 1.78E−09 | 1.97E−10 | 3.09E−09 | 6.09E−10 | N.N. | N.N. |
| ADI-20998 | Infant 2042 | 2.57E−10 | N.B. | 1.35E−09 | N.B. | 0.03 | N.N. |
| ADI-20999 | Infant 2042 | 4.16E−09 | N.B. | 2.41E−08 | N.B. | N.N. | N.N. |
| ADI-21000 | Infant 2042 | 1.49E−09 | 2.95E−10 | 1.30E−09 | 6.02E−10 | N.N. | N.N. |
| ADI-21001 | Infant 2042 | 2.12E−09 | 2.77E−10 | 1.85E−09 | 3.02E−10 | N.N. | N.N. |
| ADI-21002 | Infant 2042 | 2.36E−09 | 2.14E−10 | 8.60E−09 | 6.39E−09 | N.N. | N.N. |
| ADI-21003 | Infant 2042 | 4.75E−09 | 4.40E−10 | 9.87E−10 | 4.21E−10 | N.N. | N.N. |

TABLE 2-continued

Summary of antibody characteristics

| | | | | | | | |
|---|---|---|---|---|---|---|---|
| ADI-21004 | Infant 2042 | 4.59E−09 | 5.40E−10 | 1.02E−08 | 7.98E−10 | N.N. | 4.78 |
| ADI-21005 | Infant 2042 | 3.37E−09 | N.B. | 7.70E−09 | N.B. | N.N. | N.N. |
| ADI-21006 | Infant 2042 | 1.04E−08 | N.B. | N.B. | N.B. | N.N. | N.N. |
| ADI-21007 | Infant 2042 | 1.48E−09 | 1.71E−10 | 1.72E−09 | 1.71E−10 | N.N. | N.N. |
| ADI-21008 | Infant 2042 | 5.68E−09 | 9.18E−10 | 4.14E−09 | 1.45E−09 | N.N. | N.N. |
| ADI-21009 | Infant 2042 | 4.88E−09 | N.B. | 1.95E−08 | N.B. | N.N. | N.N. |
| ADI-21010 | Infant 2042 | 3.58E−09 | N.B. | N.B. | N.B. | N.N. | N.N. |
| ADI-21011 | Infant 2042 | 1.41E−09 | 1.62E−10 | 9.82E−10 | 3.56E−10 | N.N. | N.N. |
| ADI-21012 | Infant 2042 | 3.71E−10 | 2.14E−10 | 1.92E−09 | 2.80E−10 | N.N. | N.N. |
| ADI-21013 | Infant 2042 | 2.29E−09 | N.B. | 1.79E−09 | N.B. | 0.08 | 0.14 |
| ADI-21014 | Infant 2042 | 4.08E−10 | N.B. | 3.78E−10 | N.B. | 0.05 | 0.17 |
| ADI-21015 | Infant 2042 | 4.41E−09 | N.B. | 3.24E−08 | N.B. | 1.46 | 1.15 |
| ADI-21017 | Infant 2042 | 3.05E−10 | N.B. | 1.56E−09 | N.B. | N.N. | N.N. |
| ADI-21018 | Infant 2042 | 3.50E−10 | N.B. | 3.66E−10 | N.B. | 0.24 | 0.34 |
| ADI-21019 | Infant 2042 | 1.82E−10 | 1.54E−10 | 9.62E−10 | 1.68E−10 | 6.25 | 6.25 |
| ADI-21021 | Infant 2042 | 2.55E−09 | N.B. | 4.50E−09 | N.B. | N.N. | N.N. |
| ADI-21022 | Infant 2042 | N.B. | 2.56E−10 | 1.74E−08 | 3.57E−10 | N.N. | N.N. |
| ADI-21023 | Infant 2042 | 2.64E−10 | N.B. | 3.16E−10 | N.B. | 0.12 | 0.26 |
| ADI-21025 | Infant 2042 | 2.42E−10 | N.B. | 2.95E−10 | N.B. | 0.09 | 0.19 |
| ADI-21026 | Infant 2042 | 6.35E−09 | 9.45E−10 | 3.99E−09 | 1.43E−09 | N.N. | N.N. |
| ADI-21027 | Infant 2042 | 2.96E−10 | N.B. | 3.40E−10 | N.B. | 0.13 | 0.27 |
| ADI-21028 | Infant 2042 | 5.45E−09 | N.B. | 3.33E−09 | N.B. | N.N. | 9.09 |
| ADI-21029 | Infant 2042 | 3.77E−09 | N.B. | 8.38E−10 | N.B. | N.N. | 0.96 |
| ADI-21030 | Infant 2042 | 2.57E−10 | N.B. | 3.01E−10 | N.B. | 0.16 | 0.26 |
| ADI-21031 | Infant 2042 | 1.07E−09 | N.B. | 1.50E−09 | N.B. | 0.31 | 3.36 |
| ADI-21032 | Infant 2042 | 2.96E−10 | N.B. | 3.44E−10 | N.B. | 0.10 | 0.30 |
| ADI-21033 | Infant 2042 | 1.93E−10 | N.B. | 1.40E−09 | N.B. | 4.64 | 9.20 |
| ADI-21034 | Infant 2042 | 1.45E−10 | N.B. | 1.74E−10 | N.B. | N.N. | 7.30 |
| ADI-21035 | Infant 2042 | 1.03E−08 | N.B. | N.B. | N.B. | N.N. | N.N. |
| ADI-21036 | Infant 2042 | 5.52E−09 | N.B. | N.B. | N.B. | N.N. | N.N. |
| ADI-21037 | Infant 2042 | 1.95E−09 | 2.48E−10 | 4.81E−09 | 3.17E−09 | N.N. | N.N. |
| ADI-21038 | Infant 2042 | 2.93E−09 | 1.45E−09 | 1.60E−08 | N.B. | N.N. | N.N. |
| ADI-21039 | Infant 2042 | 1.71E−09 | 2.40E−10 | 1.27E−08 | 6.31E−09 | N.N. | N.N. |
| ADI-21040 | Infant 2042 | N.B. | 7.77E−10 | N.B. | 1.03E−09 | N.N. | N.N. |
| ADI-21041 | Infant 2042 | 7.30E−09 | N.B. | N.B. | N.B. | N.N. | N.N. |
| ADI-21042 | Infant 2042 | 2.96E−09 | 2.87E−10 | 1.18E−09 | 3.98E−10 | N.N. | N.N. |
| ADI-21043 | Infant 2042 | 1.11E−10 | 1.65E−09 | 1.54E−10 | 1.93E−09 | 0.19 | 0.08 |
| ADI-21044 | Infant 2042 | 4.51E−09 | N.B. | 5.85E−09 | N.B. | N.N. | 2.13 |
| ADI-21045 | Infant 2042 | 4.56E−10 | N.B. | 5.96E−10 | N.B. | 0.04 | 0.09 |
| ADI-21046 | Infant 2042 | 1.66E−09 | 1.87E−10 | 6.94E−10 | 2.24E−10 | N.N. | N.N. |
| ADI-21047 | Infant 2042 | 2.11E−09 | 2.90E−10 | 7.56E−10 | 2.62E−10 | N.N. | N.N. |
| ADI-21048 | Infant 2042 | 1.11E−10 | P.F. | P.F. | P.F. | 0.08 | 0.16 |
| ADI-21049 | Infant 2042 | 3.97E−10 | N.B. | 1.27E−09 | N.B. | 0.62 | 0.56 |
| ADI-21050 | Infant 2042 | 3.62E−10 | N.B. | 3.23E−10 | N.B. | 0.08 | 0.12 |
| ADI-21051 | Infant 2042 | 2.92E−10 | N.B. | 3.35E−10 | N.B. | N.N. | N.N. |
| ADI-21052 | Infant 2042 | 1.26E−10 | 1.84E−08 | 1.10E−10 | P.F. | 0.05 | 0.11 |
| ADI-21053 | Infant 2042 | 7.10E−08 | 6.37E−09 | N.B. | 1.18E−07 | N.N. | N.N. |
| ADI-21054 | Infant 2042 | 1.85E−10 | 3.72E−10 | 1.39E−10 | 3.06E−10 | 0.09 | 0.49 |
| ADI-21055 | Infant 2042 | 1.10E−09 | 1.85E−10 | 2.98E−09 | 4.35E−09 | ND | ND |
| ADI-21056 | Infant 2042 | 2.51E−10 | 7.22E−08 | 2.23E−10 | 6.34E−08 | 0.00 | 0.02 |
| ADI-21057 | Infant 2042 | 9.36E−10 | N.B. | 8.60E−10 | N.B. | 0.00 | 0.00 |
| ADI-21058 | Infant 2042 | 9.72E−10 | N.B. | 5.15E−10 | N.B. | 0.04 | 0.48 |
| ADI-21059 | Infant 2042 | 3.05E−09 | N.B. | 9.43E−09 | N.B. | N.N. | 0.30 |
| ADI-21060 | Infant 2042 | 4.26E−10 | N.B. | 3.49E−10 | N.B. | 0.06 | 0.14 |
| ADI-21061 | Infant 2042 | 1.10E−09 | 1.42E−10 | 2.76E−09 | 2.48E−09 | N.N. | N.N. |
| ADI-21062 | Infant 2042 | 1.24E−09 | 2.36E−10 | 8.27E−10 | 4.17E−10 | N.N. | N.N. |
| ADI-21063 | Infant 2042 | 8.34E−10 | N.B. | 7.77E−10 | N.B. | 0.04 | 0.11 |
| ADI-21064 | Infant 2042 | 3.20E−10 | N.B. | 2.80E−10 | N.B. | 0.03 | 0.12 |
| ADI-21065 | Infant 2042 | 1.71E−10 | N.B. | P.F. | N.B. | N.N. | N.N. |
| ADI-21067 | Infant 2042 | 3.98E−09 | N.B | 5.90E−09 | N.B | ND | ND |
| ADI-21068 | Infant 2042 | 2.55E−10 | 1.55E−08 | 2.38E−10 | 7.85E−09 | 0.10 | N.N. |
| ADI-21069 | Infant 2042 | 1.23E−10 | P.F. | 1.19E−10 | P.F. | 0.11 | 0.26 |
| ADI-21070 | Infant 2042 | 5.37E−09 | N.B. | 7.59E−09 | N.B. | N.N. | 2.38 |
| ADI-21071 | Infant 2042 | 1.17E−09 | 2.16E−10 | 1.88E−09 | 1.38E−09 | N.N. | N.N. |
| ADI-21072 | Infant 2042 | 3.41E−10 | N.B. | 3.32E−10 | N.B. | 0.04 | 0.33 |
| ADI-21073 | Infant 2042 | 4.06E−09 | 5.80E−10 | 1.78E−09 | 6.75E−10 | ND | 11.15 |
| ADI-21075 | Infant 2042 | 4.07E−10 | N.B. | 5.15E−10 | N.B. | 0.03 | 0.48 |
| ADI-21076 | Infant 2042 | 2.19E−10 | 7.34E−09 | 1.96E−10 | 6.28E−09 | 0.03 | 0.30 |
| ADI-21077 | Infant 2042 | 4.28E−10 | N.B. | 3.83E−10 | N.B. | 0.06 | 0.06 |
| ADI-21078 | Infant 2042 | 3.11E−10 | N.B. | 3.07E−10 | N.B. | 0.03 | 0.20 |
| ADI-21079 | Infant 2042 | 3.13E−10 | N.B. | 3.08E−10 | N.B. | 0.20 | 0.29 |
| ADI-21080 | Infant 2042 | 3.60E−10 | N.B. | 3.72E−10 | N.B. | 0.10 | 0.17 |
| ADI-21081 | Infant 2042 | 2.84E−10 | N.B. | 2.77E−10 | N.B. | 0.10 | 0.32 |
| ADI-21082 | Infant 2042 | 2.85E−10 | N.B. | 2.81E−10 | 6.17E−09 | 0.09 | 0.25 |
| ADI-21083 | Infant 2042 | 2.25E−09 | N.B. | 2.65E−09 | N.B. | 0.36 | 0.79 |
| ADI-21084 | Infant 2042 | 1.09E−10 | 1.73E−08 | 1.04E−10 | 2.29E−08 | 0.14 | 0.46 |
| ADI-21085 | Infant 2042 | 3.07E−10 | N.B. | 3.09E−10 | 6.24E−09 | 0.10 | 0.48 |
| ADI-21086 | Infant 2042 | 2.90E−10 | N.B. | 2.76E−10 | N.B. | 0.11 | 0.47 |

TABLE 2-continued

Summary of antibody characteristics

| ADI-21087 | Infant 2042 | N.B. | 5.45E−10 | N.B. | 4.76E−10 | N.N. | N.N. |
|---|---|---|---|---|---|---|---|
| ADI-21089 | Infant 2042 | 2.82E−10 | N.B. | 2.62E−10 | 3.34E−09 | 0.27 | 0.17 |
| ADI-21090 | Infant 2042 | 1.17E−09 | 1.76E−10 | 4.89E−10 | 1.75E−10 | ND | ND |
| ADI-21091 | Infant 2042 | 7.49E−10 | N.B. | 1.39E−09 | N.B. | 0.29 | 0.92 |

| Name | Antigenic Site Assignment | PSR Score | VH germline gene usage | LC germline gene usage | Number of nucleotide substitutions in VH | Number of nucleotide substitutions in VL |
|---|---|---|---|---|---|---|
| ADI-25462 | Site III | 0.001 | VH3-21 | VL1-40 | 1 | 0 |
| ADI-25467 | Unknown | 0.000 | VH4-59 | VK1-39 | 0 | 0 |
| ADI-25468 | Unknown | 0.402 | VH5-51 | VL3-1 | 0 | 0 |
| ADI-25472 | Site III | 0.000 | VH3-21 | VL1-40 | 0 | 0 |
| ADI-25478 | Site III | 0.817 | VH3-21 | VL1-40 | 0 | 0 |
| ADI-25479 | Site III | 0.373 | VH3-21 | VL1-40 | 0 | 0 |
| ADI-25480 | Site III | 0.340 | VH3-21 | VL1-40 | 0 | 0 |
| ADI-25484 | Site III | 0.000 | VH3-21 | VL1-40 | 0 | 0 |
| ADI-25491 | Site I | 0.000 | VH4-31 | VL3-1 | 0 | 0 |
| ADI-25495 | Site III | 0.000 | VH3-21 | VL2-14 | 0 | 1 |
| ADI-25496 | Unknown | 0.000 | VH3-21 | VL1-40 | 0 | 0 |
| ADI-25497 | Site III | 0.000 | VH3-7 | VK1D-16 | 0 | 0 |
| ADI-25502 | Site III | 0.043 | VH1-69 | VL3-27 | 0 | 1 |
| ADI-25503 | Site III | 0.277 | VH1-69 | VL3-1 | 0 | 0 |
| ADI-25505 | Site III | 0.000 | VH3-21 | VL1-40 | 0 | 0 |
| ADI-25514 | Site II | 0.493 | VH1-69 | VL3-1 | 0 | 0 |
| ADI-25517 | Site I | 0.107 | VH1-2 | VL2-14 | 0 | 1 |
| ADI-25518 | Site I | 0.116 | VH1-2 | VL2-14 | 0 | 1 |
| ADI-25524 | Site III | 0.000 | VH3-21 | VL1-40 | 0 | 0 |
| ADI-25532 | Site III | 0.000 | VH3-21 | VL1-40 | 0 | 0 |
| ADI-25533 | Site I | 0.006 | VH1-2 | VL2-14 | 0 | 1 |
| ADI-25542 | Site I | 0.000 | VH3-23 | VL8-61 | 0 | 0 |
| ADI-25547 | Unknown | 0.000 | VH3-53 | VK1-12 | 0 | 0 |
| ADI-25548 | Unknown | 0.010 | VH3-53 | VL2-11 | 0 | 0 |
| ADI-25549 | Site III | 0.702 | VH3-21 | VL1-40 | 0 | 0 |
| ADI-25555 | Site III | 0.029 | VH3-21 | VL1-40 | 0 | 0 |
| ADI-25556 | Site III | 0.000 | VH3-21 | VL1-40 | 0 | 0 |
| ADI-25557 | Site III | 0.000 | VH3-21 | VL1-40 | 0 | 0 |
| ADI-25559 | Site III | 0.000 | VH3-21 | VL1-40 | 0 | 0 |
| ADI-25562 | Site III | 0.105 | VH3-11 | VL1-40 | 0 | 0 |
| ADI-25565 | Site III | 0.108 | VH3-21 | VL1-40 | 0 | 0 |
| ADI-25567 | Site I | 0.000 | VH4-34 | VK4-1 | 0 | 0 |
| ADI-25569 | Site I | 0.000 | VH3-74 | VL3-25 | 0 | 1 |
| ADI-25572 | Site IV | 0.184 | VH1-2 | VK2-28 | 0 | 0 |
| ADI-25573 | Unknown | 0.000 | VH1-46 | VL3-21 | 0 | 1 |
| ADI-25575 | Unknown | 0.000 | VH1-46 | VL3-21 | 0 | 0 |
| ADI-25576 | Site I | 0.000 | VH3-74 | VL6-57 | 0 | 0 |
| ADI-25577 | Site III | 0.028 | VH3-21 | VL1-40 | 0 | 0 |
| ADI-25587 | Unknown | 0.000 | VH3-33 | VL2-14 | 0 | 1 |
| ADI-25588 | Site III | 0.100 | VH3-21 | VL1-40 | 0 | 0 |
| ADI-25595 | Site III | 0.012 | VH3-21 | VL1-40 | 0 | 0 |
| ADI-25598 | Site I | 0.106 | VH4-39 | VL3-25 | 5 | 1 |
| ADI-19420 | Site III | 0.709 | VH3-21 | VL1-40 | 0 | 0 |
| ADI-19421 | Site III | 0.120 | VH3-30 | VL2-14 | 0 | 1 |
| ADI-19422 | Site IV | 0.102 | VH3-30 | VL3-21 | 0 | 0 |
| ADI-19424 | Site IV | 0.020 | VH3-66 | VL3-21 | 4 | 0 |
| ADI-19425 | Site III | 0.007 | VH3-21 | VL1-40 | 0 | 0 |
| ADI-19426 | Site IV | 0.023 | VH4-59 | VL3-1 | 0 | 0 |
| ADI-19427 | Site III | 0.022 | VH3-21 | VL1-40 | 3 | 4 |
| ADI-19428 | Site III | 0.058 | VH3-21 | VL1-40 | 0 | 0 |
| ADI-19429 | Site I | 0.616 | VH4-39 | VL1-40 | 0 | 0 |
| ADI-19430 | Site I | 0.744 | VH1-69 | VK2-28 | 0 | 0 |
| ADI-19431 | Site III | 0.068 | VH3-21 | VL1-40 | 0 | 0 |
| ADI-19432 | Site IV | 0.000 | VH1-46 | VK1-05 | 0 | 0 |
| ADI-19433 | Site III | 0.000 | VH3-21 | VL1-40 | 0 | 0 |
| ADI-19435 | Site I | 0.000 | VH4-61 | VL3-01 | 0 | 1 |
| ADI-19436 | Site I | 0.073 | VH4-39 | VL3-1 | 0 | 0 |
| ADI-19437 | Unknown | 0.000 | VH1-18 | VK1-12 | 0 | 0 |
| ADI-19439 | Site III | 0.000 | VH3-23 | VK1-05 | 0 | 0 |
| ADI-19440 | Site III | 0.000 | VH3-48 | VL1-40 | 0 | 0 |
| ADI-19441 | Site I | 0.417 | VH1-69 | VK1-39 | 0 | 0 |
| ADI-19444 | Site V | 0.000 | VH1-18 | VK4-01 | 0 | 0 |
| ADI-19445 | Unknown | 0.002 | VH4-4 | VL3-21 | 0 | 1 |
| ADI-19447 | Site III | 0.029 | VH4-39 | VL3-01 | 0 | 0 |
| ADI-19448 | Site III | 0.000 | VH3-21 | VL1-40 | 0 | 0 |
| ADI-19449 | Site III | 0.142 | VH3-21 | VL1-40 | 0 | 0 |
| ADI-19450 | Unknown | 0.000 | VH3-23 | VK1-05 | 0 | 0 |
| ADI-19454 | Site III | 0.012 | VH3-21 | VL2-14 | 0 | 1 |

TABLE 2-continued

Summary of antibody characteristics

| | | | | | | |
|---|---|---|---|---|---|---|
| ADI-19455 | Site III | 0.007 | VH3-21 | VL1-40 | 0 | 0 |
| ADI-19457 | Site III | 0.000 | VH3-21 | VL1-40 | 0 | 0 |
| ADI-19458 | Site III | 0.101 | VH3-21 | VL1-40 | 3 | 0 |
| ADI-19459 | Site IV | 0.026 | VH3-66 | VL3-21 | 0 | 0 |
| ADI-19460 | Site I | 0.076 | VH4-34 | VK1-39 | 0 | 0 |
| ADI-19461 | Site II | 0.000 | VH3-11 | VL3-21 | 0 | 0 |
| ADI-19462 | Site IV | 0.000 | VH2-5 | VK1-5 | 0 | 0 |
| ADI-19463 | Unknown | 0.065 | VH4-304 | VK4-1 | 0 | 0 |
| ADI-19465 | Site III | 0.000 | VH3-21 | VL1-40 | 0 | 0 |
| ADI-19506 | Unknown | 0.424 | VH1-18 | VK2-28 | 0 | 0 |
| ADI-19507 | Site III | 0.000 | VH3-21 | VL1-40 | 0 | 0 |
| ADI-19509 | Site III | 0.000 | VH3-21 | VL1-40 | 0 | 0 |
| ADI-19510 | Site III | 0.108 | VH3-21 | N/A | 6 | 2 |
| ADI-19511 | Unknown | 0.444 | VH2-5 | VK1-17 | 0 | 0 |
| ADI-24792 | Site III | 0.000 | VH3-11 | VL1-40 | 5 | 2 |
| ADI-24793 | Site I | 0.000 | VH5-51 | VL6-57 | 1 | 2 |
| ADI-24795 | Site III | 0.000 | VH3-21 | VL1-40 | 0 | 0 |
| ADI-24796 | Unknown | 0.000 | VH3-33 | VL3-1 | 0 | 0 |
| ADI-24798 | Site I | 0.000 | VH4-59 | VL3-1 | 0 | 0 |
| ADI-24799 | Site III | 0.000 | VH3-21 | VL1-40 | 0 | 0 |
| ADI-24800 | Site III | 0.843 | VH3-21 | VL1-40 | 0 | 2 |
| ADI-24801 | Site III | 0.158 | VH1-18 | VL3-1 | 0 | 1 |
| ADI-24803 | Unknown | 0.077 | VH3-23 | VK3-20 | 6 | 3 |
| ADI-24805 | Site III | 0.000 | VH3-21 | VL1-40 | 0 | 0 |
| ADI-24807 | Site I | 0.083 | VH4-39 | VL3-1 | 0 | 0 |
| ADI-24808 | Site I | 0.000 | VH1-2 | VL2-8 | 0 | 0 |
| ADI-24811 | Site IV | 0.112 | VH1-8 | VL3-21 | 0 | 0 |
| ADI-24812 | Site V | 0.000 | VH3-23 | VL3-25 | 4 | 1 |
| ADI-24813 | Site IV | 0.000 | VH3-9 | VL1-40 | 0 | 0 |
| ADI-24814 | Site IV | 0.117 | VH3-30 | VK3-20 | 2 | 3 |
| ADI-24815 | Site III | 0.000 | VH3-21 | VL1-40 | 0 | 0 |
| ADI-24816 | Site I | 0.102 | VH1-8 | VL3-1 | 0 | 0 |
| ADI-24817 | Site III | 0.000 | VH3-21 | VL1-40 | 0 | 0 |
| ADI-24818 | Site I | 0.000 | VH1-2 | VL2-14 | 0 | 1 |
| ADI-24819 | Site III | 0.000 | VH3-21 | VL1-40 | 0 | 0 |
| ADI-24820 | Unknown | 0.248 | VH1-69 | VK1-39 | 0 | 0 |
| ADI-24821 | Site II | 0.000 | VH3-9 | VL1-44 | 0 | 0 |
| ADI-24822 | Site III | 0.000 | VH3-21 | VL1-40 | 0 | 0 |
| ADI-24823 | Site III | 0.000 | VH3-21 | VL1-40 | 0 | 0 |
| ADI-24824 | Site III | 0.000 | VH4-59 | VK1-8 | 0 | 0 |
| ADI-24825 | Unknown | 0.338 | VH1-8 | VK2-28 | 0 | 0 |
| ADI-24826 | Site III | 0.102 | VH3-21 | VL2-14 | 0 | 1 |
| ADI-24827 | Site 0 | 0.000 | VH3-66 | VK3-15 | 1 | 0 |
| ADI-24828 | Site III | 0.109 | VH3-21 | VL1-40 | 9 | 2 |
| ADI-24829 | Site III | 0.000 | VH3-21 | VL1-40 | 0 | 0 |
| ADI-24830 | Site V | 0.000 | VH1-69 | VK2-28 | 0 | 0 |
| ADI-24831 | Site III | 0.164 | VH3-21 | VL1-40 | 0 | 0 |
| ADI-24832 | Site III | 0.360 | VH3-21 | VL1-40 | 6 | 1 |
| ADI-24833 | Site III | 0.000 | VH3-21 | VL1-40 | 0 | 0 |
| ADI-24834 | Site I | 0.293 | VH3-23 | VK1-5 | 1 | 1 |
| ADI-24835 | Site III | 0.000 | VH3-21 | VL1-40 | 5 | 5 |
| ADI-24836 | Unknown | 0.106 | VH3-9 | VK1-39 | 0 | 0 |
| ADI-24837 | Unknown | 0.000 | VH4-59 | VL1-51 | 0 | 0 |
| ADI-24838 | Site III | 0.122 | VH3-21 | VL1-40 | 0 | 0 |
| ADI-24839 | Site III | 0.000 | VH3-21 | VL1-40 | 0 | 0 |
| ADI-24840 | Site III | 0.000 | VH3-21 | VL1-40 | 0 | 0 |
| ADI-24841 | Unknown | 0.144 | VH1-3 | VK3-15 | 0 | 0 |
| ADI-24842 | Site III | 0.000 | VH3-21 | VL1-40 | 0 | 2 |
| ADI-24843 | Unknown | 0.039 | VH4-304 | VK4-1 | 0 | 0 |
| ADI-24845 | Site III | 0.000 | VH3-21 | VL2-14 | 0 | 0 |
| ADI-24846 | Unknown | 0.000 | VH3-21 | VL1-47 | 0 | 0 |
| ADI-24847 | Unknown | 0.012 | VH3-21 | VL1-40 | 1 | 0 |
| ADI-24848 | Site V | 0.644 | VH3-21 | VL1-40 | 0 | 0 |
| ADI-24849 | Site 0 | 0.741 | VH3-43 | VK1-33 | 2 | 0 |
| ADI-24850 | Site III | 0.574 | VH3-21 | VL1-40 | 0 | 0 |
| ADI-24851 | Site I | 0.675 | VH1-2 | VL2-8 | 0 | 0 |
| ADI-24852 | Site IV | 0.277 | VH1-3 | VL3-1 | 1 | 2 |
| ADI-24854 | Unknown | 0.658 | VH3-21 | VL1-40 | 0 | 0 |
| ADI-24855 | Site III | 0.600 | VH3-21 | VL1-40 | 0 | 0 |
| ADI-24856 | Site I | 0.101 | VH1-18 | VK3-20 | 0 | 0 |
| ADI-24857 | Site III | 0.000 | VH3-21 | VL1-40 | 0 | 0 |
| ADI-24858 | Site III | 0.119 | VH3-21 | VL1-40 | 0 | 0 |
| ADI-24859 | Site III | 0.000 | VH3-21 | VL1-40 | 0 | 0 |
| ADI-24860 | Site III | 0.000 | VH3-11 | VL1-40 | 4 | 2 |
| ADI-24861 | Site III | 0.000 | VH3-21 | VL1-40 | 2 | 0 |
| ADI-24862 | Unknown | 0.000 | VH4-31 | VL3-1 | 0 | 0 |
| ADI-24863 | Site III | 0.000 | VH3-21 | VL1-40 | 1 | 0 |
| ADI-19467 | Site III | 0.010 | VH3-21 | VL1-40 | 0 | 0 |

TABLE 2-continued

Summary of antibody characteristics

| | | | | | | |
|---|---|---|---|---|---|---|
| ADI-19468 | Site I | 0.000 | VH4-39 | VL6-57 | 0 | 0 |
| ADI-19469 | Site I | 0.143 | VH4-b | VK3-11 | 0 | 0 |
| ADI-19470 | Site II | 0.110 | VH3-30 | VL3-1 | 0 | 0 |
| ADI-19471 | Unknown | 0.040 | VH3-64 | VL6-57 | 0 | 0 |
| ADI-19473 | Site I | 0.063 | VH5-51 | VL6-57 | 0 | 0 |
| ADI-19474 | Site I | 0.032 | VH5-51 | VL6-57 | 0 | 0 |
| ADI-19475 | Site V | 0.000 | VH1-18 | VK2-30 | 10 | 2 |
| ADI-19476 | Unknown | 0.093 | VH2-5 | VL2-11 | 2 | 3 |
| ADI-19478 | Unknown | 0.033 | VH4-39 | VL1-36 | 5 | 2 |
| ADI-19479 | Unknown | 0.012 | VH1-69 | VK2-30 | 2 | 3 |
| ADI-19480 | Site IV | 0.012 | VH3-21 | VL6-57 | 6 | 3 |
| ADI-19481 | Unknown | 0.000 | VH3-43 | VK1-39 | 1 | 3 |
| ADI-19482 | Site II | 0.159 | VH4-34 | VK1-5 | 11 | 1 |
| ADI-19483 | Site IV | 0.050 | VH5-51 | VL6-57 | 4 | 2 |
| ADI-19484 | Unknown | 0.000 | VH4-30 | VK1-39 | 5 | 2 |
| ADI-19485 | Site I | 0.039 | VH4-31 | VK3-15 | 11 | 3 |
| ADI-19486 | Site I | 0.006 | VH4-59 | VL2-14 | 5 | 0 |
| ADI-19487 | Unknown | 0.104 | VH2-70 | VK1-39 | 3 | 0 |
| ADI-19488 | Unknown | 0.000 | VH1-24 | VK2-28 | 0 | 0 |
| ADI-19489 | Site IV | 0.000 | VH2-70 | VK1-17 | 2 | 0 |
| ADI-19490 | Unknown | 0.000 | VH3-15 | VK2-28 | 0 | 0 |
| ADI-19491 | Unknown | 0.000 | VH2-5 | VL1-40 | 0 | 0 |
| ADI-19492 | Site IV | 0.034 | VH5-51 | VL6-57 | 1 | 2 |
| ADI-19493 | Site I | 0.037 | VH4-34 | VL3-1 | 0 | 0 |
| ADI-19494 | Site 0 | 0.065 | VH1-69 | VL2-14 | 4 | 1 |
| ADI-19495 | Unknown | 0.047 | VH4-59 | VK1-12 | 0 | 0 |
| ADI-19496 | Unknown | 0.000 | VH3-30 | VK4-1 | 1 | 1 |
| ADI-19497 | Site I | 0.002 | VH1-46 | VL6-57 | 0 | 0 |
| ADI-19498 | Site I | 0.045 | VH3-66 | VL3-25 | 1 | 0 |
| ADI-19499 | Site I | 0.089 | VH4-39 | VL6-57 | 0 | 0 |
| ADI-19500 | Unknown | 0.000 | VH3-48 | VK1-8 | 0 | 0 |
| ADI-19501 | Site V | 0.000 | VH1-18 | VK2-30 | 6 | 2 |
| ADI-19502 | Unknown | 0.000 | VH3-30 | VK4-1 | 5 | 2 |
| ADI-19503 | Site I | 0.040 | VH1-46 | VL3-10 | 0 | 0 |
| ADI-19505 | Site IV | 0.039 | VH5-51 | VL3-9 | 5 | 1 |
| ADI-22756 | Unknown | 0.171 | VH3-30 | VK3-20 | 6 | 4 |
| ADI-22757 | Site V | 0.000 | VH1-18 | VK2-30 | 7 | 4 |
| ADI-22758 | Site III | 0.000 | VH3-21 | VL1-40 | 5 | 3 |
| ADI-22759 | Site III | 0.018 | VH3-21 | VL1-40 | 9 | 3 |
| ADI-22760 | Site II | 0.000 | VH3-9 | VL1-47 | 5 | 4 |
| ADI-22762 | Site I | 0.000 | VH6-1 | VL1-40 | 7 | 4 |
| ADI-22763 | Site I | 0.000 | VH3-48 | VK1-39 | 9 | 3 |
| ADI-22764 | Site I | 0.336 | VH4-4 | VK1-39 | 5 | 12 |
| ADI-22765 | Site V | 0.000 | VH3-21 | VL1-40 | 0 | 0 |
| ADI-22766 | Unknown | 0.000 | VH3-9 | VL2-8 | 0 | 1 |
| ADI-22767 | Site III | 0.033 | VH3-21 | VL1-40 | 0 | 0 |
| ADI-22768 | Site I | 0.000 | VH3-48 | VK1-39 | 0 | 0 |
| ADI-22769 | Unknown | 0.011 | VH3-72 | VL3-1 | 0 | 0 |
| ADI-22770 | Unknown | 0.004 | VH2-70 | VL3-1 | 0 | 0 |
| ADI-22771 | Site III | 0.010 | VH3-21 | VL1-40 | 0 | 0 |
| ADI-22772 | Unknown | 0.000 | VH3-30 | VL3-1 | 0 | 0 |
| ADI-22773 | Site V | 0.000 | VH1-18 | VK2-30 | 0 | 0 |
| ADI-22774 | Site III | 0.000 | VH3-21 | VL1-40 | 0 | 4 |
| ADI-22775 | Unknown | 0.000 | VH3-33 | VK1-12 | 4 | 2 |
| ADI-22776 | Unknown | 0.000 | VH3-11 | VL3-21 | 0 | 0 |
| ADI-22777 | Site II | 0.000 | VH1-02 | VL3-01 | 12 | 13 |
| ADI-22778 | Site I | 0.109 | VH4-59 | VK1-39 | 12 | 7 |
| ADI-22779 | Site I | 0.000 | VH4-34 | VK1-39 | 7 | 8 |
| ADI-22780 | Site III | 0.004 | VH4-31 | VL2-14 | 0 | 2 |
| ADI-22781 | Site I | 0.033 | VH3-48 | VL3-01 | 0 | 0 |
| ADI-14333 | Site III | 0.046 | VH3-21 | VL1-40 | 7 | 4 |
| ADI-14334 | Site III | 0.005 | VH3-21 | VL1-40 | 14 | 4 |
| ADI-14335 | Site IV | 0.000 | VH3-49 | VK1-39 | 4 | 6 |
| ADI-14336 | Site V | 0.005 | VH1-18 | VK2-30 | 4 | 5 |
| ADI-14337 | Site III | 0.000 | VH3-21 | VL1-40 | 0 | 0 |
| ADI-14338 | Site I | 0.000 | VH3-30 | VK1-39 | 13 | 3 |
| ADI-14339 | Site IV | 0.040 | VH3-30 | VL3-25 | 14 | 4 |
| ADI-14340 | Site 0 | 0.050 | VH3-21 | VL3-21 | 7 | 5 |
| ADI-14341 | Unknown | 0.111 | VH3-48 | VK1-5 | 7 | 1 |
| ADI-14342 | Site I | 0.000 | VH2-26 | VK1-39 | 3 | 6 |
| ADI-14343 | Site I | 0.003 | VH1-69 | VK2-28 | 8 | 5 |
| ADI-14344 | Unknown | 0.113 | VH3-23 | VL3-1 | 8 | 7 |
| ADI-14345 | Site IV | 0.059 | VH1-24 | VK1-39 | 9 | 1 |
| ADI-14346 | Site III | 0.102 | VH3-21 | VL1-40 | 8 | 1 |
| ADI-14347 | Site III | 0.040 | VH3-21 | VL1-40 | 6 | 1 |
| ADI-14348 | Site I | 0.105 | VH3-30 | VL2-11 | 10 | 5 |
| ADI-14349 | Unknown | 0.000 | VH1-69 | VK4-1 | 9 | 3 |
| ADI-14350 | Site II | 0.027 | VH4-61 | VL1-40 | 13 | 2 |

TABLE 2-continued

Summary of antibody characteristics

| | | | | | | |
|---|---|---|---|---|---|---|
| ADI-14351 | Site IV | 0.027 | VH3-74 | VL3-21 | 9 | 3 |
| ADI-14352 | Unknown | 0.142 | VH4-304 | VK3-20 | 5 | 3 |
| ADI-14353 | Site I | 0.051 | VH1-69 | VL2-14 | 10 | 4 |
| ADI-14354 | Site I | 0.069 | VH1-69 | VL2-14 | 8 | 6 |
| ADI-14355 | Site IV | 0.038 | VH2-5 | VL2-14 | 4 | 7 |
| ADI-14356 | Site I | 0.034 | VH4-34 | VL3-25 | 0 | 0 |
| ADI-14357 | Unknown | 0.000 | VH3-30 | VK1-39 | 5 | 4 |
| ADI-14358 | Site I | 0.103 | VH3-11 | VL2-14 | 7 | 12 |
| ADI-14359 | Site I | 0.000 | VH2-70 | VK1-39 | 1 | 0 |
| ADI-14360 | Site IV | 0.000 | VH1-3 | VK2-28 | 2 | 0 |
| ADI-14361 | Unknown | 0.068 | VH3-23 | VL1-40 | 14 | 7 |
| ADI-14362 | Site I | 0.389 | VH3-23 | VK1-39 | 2 | 1 |
| ADI-14363 | Site IV | 0.000 | VH3-11 | VK3-20 | 6 | 4 |
| ADI-14364 | Site 0 | 0.104 | VH5-51 | VL3-21 | 3 | 0 |
| ADI-14365 | Site IV | 0.000 | VH1-24 | VK1-39 | 8 | 4 |
| ADI-14366 | Unknown | 0.000 | VH1-18 | VK1-39 | 8 | 8 |
| ADI-14367 | Unknown | 0.000 | VH3-23 | VK3-20 | 10 | 2 |
| ADI-14368 | Site II | 0.106 | VH3-15 | VL3-21 | 4 | 6 |
| ADI-14369 | Unknown | 0.059 | VH1-69 | VL1-44 | 6 | 6 |
| ADI-14370 | Unknown | 0.726 | VH3-30 | VL2-8 | 6 | 0 |
| ADI-14371 | Unknown | 0.000 | VH3-23 | VK1-39 | 10 | 8 |
| ADI-14372 | Unknown | 0.000 | VH3-23 | VK1-6 | 11 | 3 |
| ADI-14373 | Site I | 0.000 | VH4-34 | VK3-15 | 4 | 0 |
| ADI-14374 | Unknown | 0.103 | VH3-43 | VL3-21 | 6 | 13 |
| ADI-14375 | Unknown | 0.019 | VH3-23 | VL1-40 | 10 | 6 |
| ADI-14376 | Site I | 0.085 | VH3-74 | VL3-10 | 7 | 3 |
| ADI-14377 | Unknown | 0.000 | VH3-30 | VK1-17 | 5 | 0 |
| ADI-14378 | Unknown | 0.000 | VH3-74 | VK1-39 | 3 | 3 |
| ADI-14379 | Unknown | 0.487 | VH3-30 | VL3-1 | 5 | 11 |
| ADI-14380 | Unknown | 0.102 | VH5-51 | VL1-51 | 5 | 2 |
| ADI-14381 | Site I | 0.009 | VH3-48 | VK1-6 | 7 | 1 |
| ADI-14382 | Site I | 0.118 | VH3-33 | VL2-14 | 8 | 5 |
| ADI-14383 | Site II | 0.100 | VH2-5 | VL2-23 | 6 | 4 |
| ADI-14384 | Site I | 0.062 | VH4-30 | VL3-21 | 7 | 7 |
| ADI-14385 | Site I | 0.028 | VH5-51 | VL6-57 | 0 | 1 |
| ADI-14386 | Site I | 0.070 | VH3-23 | VL3-1 | 6 | 7 |
| ADI-14388 | Unknown | 0.147 | VH3-30 | VL7-43 | 2 | 4 |
| ADI-14389 | Site I | 0.181 | VH3-15 | VK1-39 | 12 | 6 |
| ADI-14390 | Unknown | 0.129 | VH4-b | VL2-23 | 1 | 3 |
| ADI-14391 | Unknown | 0.033 | VH3-23 | VL3-10 | 11 | 4 |
| ADI-14392 | Unknown | 0.000 | VH1-69 | VK3-11 | 2 | 0 |
| ADI-14393 | Site III | 0.199 | VH3-21 | VL1-40 | 14 | 4 |
| ADI-14394 | Site III | 0.038 | VH3-21 | VL1-40 | 0 | 0 |
| ADI-14395 | Site IV | 0.128 | VH3-30 | VK1-5 | 0 | 0 |
| ADI-14396 | Unknown | 0.000 | VH3-30 | VK1-33 | 0 | 0 |
| ADI-14397 | Site IV | 0.120 | VH3-30 | VK1-5 | 0 | 0 |
| ADI-14399 | Unknown | 0.004 | VH4-304 | VK3-11 | 7 | 4 |
| ADI-14400 | Unknown | 0.000 | VH3-30 | VK1-6 | 8 | 1 |
| ADI-14401 | Site III | 0.005 | VH3-21 | VL1-40 | 9 | 4 |
| ADI-14402 | Site V | 0.000 | VH1-18 | VK2-30 | 3 | 2 |
| ADI-14403 | Site III | 0.010 | VH3-11 | VL1-40 | 7 | 4 |
| ADI-14404 | Unknown | 0.037 | VH3-48 | VK1-5 | 7 | 5 |
| ADI-14405 | Site IV | 0.031 | VH1-18 | VL3-21 | 11 | 5 |
| ADI-14406 | Site I | 0.060 | VH5-51 | VK2-28 | 10 | 1 |
| ADI-14407 | Site I | 0.000 | VH3-33 | VK1-39 | 5 | 7 |
| ADI-14408 | Site I | 0.000 | VH2-70 | VK1-39 | 5 | 5 |
| ADI-14409 | Unknown | 0.014 | VH1-18 | VK4-1 | 6 | 4 |
| ADI-14410 | Unknown | 0.101 | VH4-34 | VL1-47 | 8 | 6 |
| ADI-14411 | Unknown | 0.047 | VH1-46 | VK1-39 | 7 | 5 |
| ADI-14412 | Site IV | 0.000 | VH1-18 | VK3-20 | 9 | 5 |
| ADI-14413 | Unknown | 0.028 | VH3-43 | VL1-44 | 9 | 6 |
| ADI-14414 | Unknown | 0.109 | VH1-69 | VK3-11 | 15 | 7 |
| ADI-14415 | Unknown | 0.000 | VH4-59 | VK1-9 | 7 | 5 |
| ADI-14416 | Site IV | 0.053 | VH5-51 | VL6-57 | 23 | 5 |
| ADI-14417 | Unknown | 0.297 | VH3-21 | VK3-15 | 9 | 3 |
| ADI-14418 | Site II | 0.000 | VH1-69 | VK1-5 | 10 | 3 |
| ADI-14419 | Unknown | 0.325 | VH3-30 | VK3-20 | 9 | 1 |
| ADI-14420 | Site IV | 0.000 | VH3-43 | VK1-5 | 4 | 3 |
| ADI-14421 | Unknown | 0.055 | VH5-51 | VK3-15 | 20 | 2 |
| ADI-14422 | Site I | 0.000 | VH1-69 | VL1-40 | 1 | 0 |
| ADI-14423 | Unknown | 0.000 | VH3-43 | VK1-17 | 7 | 0 |
| ADI-14424 | Site II | 0.051 | VH5-51 | VL6-57 | 16 | 9 |
| ADI-14425 | Site I | 0.027 | VH4-61 | VL2-14 | 5 | 2 |
| ADI-14426 | Site I | 0.072 | VH3-30 | VL3-19 | 8 | 5 |
| ADI-14427 | Site I | 0.108 | VH1-69 | VL2-11 | 9 | 1 |
| ADI-14428 | Unknown | 0.110 | VH3-11 | VL3-21 | 4 | 2 |
| ADI-14654 | Unknown | 0.106 | VH1-69 | VL3-19 | 10 | 5 |
| ADI-14655 | Site I | 0.000 | VH3-15 | VK1-39 | 0 | 0 |

TABLE 2-continued

Summary of antibody characteristics

| | | | | | | |
|---|---|---|---|---|---|---|
| ADI-14656 | Site I | 0.050 | VH3-30 | VL3-19 | 8 | 5 |
| ADI-14657 | Site IV | 0.000 | VH1-18 | VK1-27 | 9 | 1 |
| ADI-14658 | Site I | 0.040 | VH3-33 | VL2-14 | 0 | 1 |
| ADI-14659 | Unknown | 0.000 | VH3-11 | VK3-20 | 9 | 10 |
| ADI-14571 | Unknown | 0.000 | VH1-69 | VK1-9 | 10 | 1 |
| ADI-14572 | Unknown | 0.148 | VH3-15 | VL1-44 | 4 | 3 |
| ADI-14573 | Unknown | 0.031 | VH1-18 | VL3-21 | 7 | 3 |
| ADI-14575 | Site I | 0.096 | VH1-69 | VL2-14 | 0 | 1 |
| ADI-14576 | Site V | 0.000 | VH1-18 | VK2-30 | 0 | 0 |
| ADI-14577 | Site V | 0.000 | VH1-18 | VK2-30 | 11 | 3 |
| ADI-14578 | Unknown | 0.120 | VH1-69 | VL1-51 | 6 | 6 |
| ADI-14579 | Site I | 0.117 | VH5-51 | VK1-27 | 2 | 0 |
| ADI-14580 | Unknown | 0.000 | VH1-69 | VK4-1 | 12 | 3 |
| ADI-14581 | Unknown | 0.000 | VH1-69 | VK3-15 | 13 | 3 |
| ADI-14582 | Site II | 0.104 | VH5-51 | VL6-57 | 15 | 8 |
| ADI-14583 | Site V | 0.000 | VH1-18 | VK2-30 | 10 | 4 |
| ADI-14584 | Unknown | 0.000 | VH1-18 | VK1-39 | 20 | 2 |
| ADI-14585 | Site V | 0.000 | VH1-18 | VK2-30 | 5 | 5 |
| ADI-14586 | Site III | 0.000 | VH3-11 | VL1-40 | 0 | 0 |
| ADI-14587 | Site III | 0.010 | VH3-21 | VL1-40 | 3 | 2 |
| ADI-14588 | Site IV | 0.000 | VH1-24 | VK1-39 | 9 | 2 |
| ADI-14589 | Site I | 0.000 | VH2-26 | VK1-39 | 6 | 8 |
| ADI-14590 | Site II | 0.000 | VH5-51 | VK1-13 | 3 | 2 |
| ADI-14591 | Unknown | 0.116 | VH5-a | VK1-39 | 7 | 4 |
| ADI-14592 | Site IV | 0.083 | VH5-51 | VL6-57 | 12 | 4 |
| ADI-14593 | Site IV | 0.017 | VH5-51 | VL6-57 | 7 | 4 |
| ADI-14594 | Unknown | 0.030 | VH1-18 | VL3-21 | 10 | 2 |
| ADI-14595 | Site I | 0.101 | VH3-48 | VK3-11 | 10 | 5 |
| ADI-14596 | Unknown | 0.052 | VH3-23 | VK1-39 | 2 | 0 |
| ADI-14597 | Site IV | 0.000 | VH3-43 | VK3-20 | 6 | 1 |
| ADI-14598 | Site I | 0.000 | VH1-69 | VK1-27 | 8 | 1 |
| ADI-14599 | Site IV | 0.092 | VH3-49 | VL6-57 | 7 | 2 |
| ADI-14600 | Site III | 0.069 | VH3-11 | VL1-40 | 3 | 1 |
| ADI-14601 | Unknown | 0.045 | VH3-23 | VK1-12 | 5 | 5 |
| ADI-14602 | Site IV | 0.114 | VH3-30 | VL3-1 | 6 | 5 |
| ADI-14603 | Unknown | 0.036 | VH5-51 | VK1-27 | 6 | 4 |
| ADI-14604 | Unknown | 0.110 | VH3-23 | VL1-44 | 11 | 7 |
| ADI-14605 | Unknown | 0.103 | VH2-70 | VL3-25 | 5 | 6 |
| ADI-14606 | Unknown | 0.000 | VH3-66 | VK3-15 | 4 | 5 |
| ADI-14607 | Site IV | 0.075 | VH3-30 | VL3-25 | 10 | 8 |
| ADI-20959 | Site V | 0.000 | VH1-18 | VK2-30 | 7 | 5 |
| ADI-20960 | Site II | 0.102 | VH4-34 | VK1-5 | 14 | 7 |
| ADI-20961 | Site III | 0.059 | VH3-21 | VL1-40 | 20 | 5 |
| ADI-20962 | Site V | 0.000 | VH1-18 | VK2-30 | 10 | 2 |
| ADI-20963 | Site I | 0.051 | VH3-21 | VL3-21 | 17 | 9 |
| ADI-20964 | Site V | 0.000 | VH1-18 | VK2-30 | 4 | 2 |
| ADI-20965 | site IV | 0.109 | VH1-18 | VL3-21 | 11 | 6 |
| ADI-20966 | Site III | 0.035 | VH3-21 | VL1-40 | 20 | 8 |
| ADI-20967 | Site I | 0.000 | VH3-30 | VK2-28 | 11 | 1 |
| ADI-20968 | site IV | 0.000 | VH4-34 | VK1-33 | 11 | 10 |
| ADI-20969 | Site III | 0.094 | VH3-21 | VL1-40 | 13 | 6 |
| ADI-20970 | Unknown | 0.000 | VH3-15 | VK1-33 | 3 | 5 |
| ADI-20971 | Site I | 0.000 | VH3-21 | VK3-15 | 20 | 7 |
| ADI-20972 | Site I | 0.103 | VH4-34 | VL2-14 | 13 | 5 |
| ADI-20973 | Site III | 0.096 | VH3-21 | VL1-40 | 13 | 6 |
| ADI-20974 | Site III | 0.107 | VH3-21 | VL1-40 | 18 | 6 |
| ADI-20975 | site IV | 0.028 | VH1-18 | VL3-21 | 20 | 8 |
| ADI-20976 | Site I | 0.000 | VH3-23 | VK1-39 | 33 | 10 |
| ADI-20977 | Unknown | 0.000 | VH3-23 | VK3-20 | 3 | 1 |
| ADI-20978 | Site V | 0.000 | VH1-18 | VK2-30 | 8 | 1 |
| ADI-20979 | Site 0 | 0.034 | VH4-59 | VL2-14 | 8 | 5 |
| ADI-20980 | Unknown | 0.000 | VH4-61 | VK3-11 | 9 | 7 |
| ADI-20981 | Unknown | 0.352 | VH4-304 | VK1-12 | 18 | 8 |
| ADI-20982 | Unknown | 0.000 | VH4-61 | VK1-5 | 15 | 7 |
| ADI-20983 | Site I | 0.000 | VH3-64 | VK1-33 | 13 | 5 |
| ADI-20984 | Site IV | 0.026 | VH1-24 | VK1-39 | 23 | 32 |
| ADI-20986 | Site 0 | 0.000 | VH3-7 | VK3-20 | 9 | 6 |
| ADI-20987 | Unknown | 0.000 | VH3-33 | VK3-20 | 7 | 2 |
| ADI-20988 | Site V | 0.000 | VH1-18 | VK2-30 | 12 | 3 |
| ADI-20989 | Site I | 0.000 | VH4-4 | VK1-39 | 9 | 9 |
| ADI-20990 | Site I | 0.000 | VH3-30 | VK2-28 | 16 | 4 |
| ADI-20991 | Site III | 0.022 | VH3-11 | VL1-40 | 8 | 2 |
| ADI-20992 | Site V | 0.000 | VH3-7 | VK1-39 | 9 | 6 |
| ADI-20993 | Site I | 0.135 | VH3-30 | VK2-28 | 13 | 7 |
| ADI-20994 | site IV | 0.020 | VH1-18 | VL3-21 | 16 | 3 |
| ADI-20995 | Unknown | 0.000 | VH5-51 | N/A | 9 | 0 |
| ADI-20996 | Site I | 0.015 | VH2-70 | VK1-39 | 3 | 8 |
| ADI-20997 | Site I | 0.000 | VH3-30 | VK3-20 | 14 | 9 |

TABLE 2-continued

Summary of antibody characteristics

| | | | | | | |
|---|---|---|---|---|---|---|
| ADI-20998 | Site 0 | 0.109 | VH3-30 | VL2-11 | 9 | 5 |
| ADI-20999 | Unknown | 0.088 | VH4-39 | VL1-51 | 15 | 5 |
| ADI-21000 | Site I | 0.000 | VH2-26 | VK1-39 | 12 | 4 |
| ADI-21001 | Site IV | 0.000 | VH4-39 | VK4-1 | 10 | 1 |
| ADI-21002 | Site I | 0.010 | VH4-4 | VK1-39 | 16 | 7 |
| ADI-21003 | Site IV | 0.000 | VH4-34 | VK2-28 | 4 | 2 |
| ADI-21004 | Site IV | 0.000 | VH3-33 | VK4-1 | 8 | 12 |
| ADI-21005 | Unknown | 0.000 | VH3-43 | VK3-20 | 16 | 6 |
| ADI-21006 | Site III | 0.000 | VH2-5 | VK2-30 | 6 | 8 |
| ADI-21007 | Site IV | 0.082 | VH1-46 | VL6-57 | 12 | 3 |
| ADI-21008 | Site I | 0.000 | VH4-34 | VK3-11 | 15 | 2 |
| ADI-21009 | Unknown | 0.040 | VH1-18 | VL2-23 | 20 | 9 |
| ADI-21010 | Site III | 0.000 | VH3-33 | VK1-5 | 15 | 6 |
| ADI-21011 | Site I | 0.109 | VH4-59 | VK1-39 | 23 | 9 |
| ADI-21012 | Site I | 0.018 | VH2-70 | VK1-39 | 7 | 7 |
| ADI-21013 | Site V | 0.000 | VH4-39 | VK3-20 | 13 | 6 |
| ADI-21014 | Site 0 | 0.112 | VH4-59 | VK1-33 | 24 | 10 |
| ADI-21015 | Site IV | 0.000 | VH1-24 | VK1-39 | 15 | 4 |
| ADI-21017 | Site V | 0.000 | VH1-18 | VK2-30 | 8 | 4 |
| ADI-21018 | Site III | 0.031 | VH3-21 | VL1-40 | 8 | 5 |
| ADI-21019 | Site IV | 0.000 | VH3-23 | VK2-28 | 15 | 3 |
| ADI-21021 | Site IV | 0.000 | VH4-34 | VK1-5 | 10 | 11 |
| ADI-21022 | Unknown | 0.003 | VH4-59 | VL3-21 | 8 | 3 |
| ADI-21023 | Site III | 0.060 | VH3-21 | VL1-40 | 16 | 8 |
| ADI-21025 | Site III | 0.033 | VH3-21 | VL1-40 | 11 | 4 |
| ADI-21026 | Site I | 0.225 | VH4-31 | VK4-1 | 9 | 7 |
| ADI-21027 | Site III | 0.008 | VH4-4 | VL1-40 | 15 | 5 |
| ADI-21028 | Unknown | 0.000 | VH3-11 | VK1-5 | 10 | 10 |
| ADI-21029 | Unknown | 0.000 | VH5-51 | VK1-39 | 14 | 3 |
| ADI-21030 | Site III | 0.060 | VH3-11 | VL1-40 | 12 | 8 |
| ADI-21031 | Unknown | 0.004 | VH4-61 | VK3-11 | 21 | 7 |
| ADI-21032 | Site III | 0.054 | VH3-21 | VL1-40 | 14 | 5 |
| ADI-21033 | Site 0 | 0.000 | VH5-51 | VK1-33 | 20 | 8 |
| ADI-21034 | Site I | 0.015 | VH5-a | VK3-20 | 11 | 5 |
| ADI-21035 | Site I | 0.033 | VH1-18 | VK1-5 | 14 | 8 |
| ADI-21036 | Site I | 0.101 | VH5-51 | VL2-23 | 16 | 16 |
| ADI-21037 | Site I | 0.122 | VH3-30 | VK2-28 | 13 | 4 |
| ADI-21038 | Site I | 0.000 | VH5-51 | VK3-20 | 15 | 1 |
| ADI-21039 | Site I | 0.102 | VH1-46 | VK2-28 | 11 | 0 |
| ADI-21040 | Unknown | 0.046 | VH4-4 | VL1-40 | 14 | 6 |
| ADI-21041 | Unknown | 0.000 | VH3-43 | VK1-39 | 3 | 3 |
| ADI-21042 | Site I | 0.000 | VH4-31 | VK1-5 | 18 | 7 |
| ADI-21043 | Site I | 0.059 | VH1-18 | VL3-21 | 8 | 4 |
| ADI-21044 | Unknown | 0.000 | VH5-51 | VK1-39 | 16 | 6 |
| ADI-21045 | Site III | 0.032 | VH3-21 | VL1-40 | 18 | 5 |
| ADI-21046 | Site IV | 0.089 | VH5-51 | VL1-40 | 16 | 7 |
| ADI-21047 | Site IV | 0.000 | VH4-34 | VK1-33 | 14 | 4 |
| ADI-21048 | site IV | 0.087 | VH1-18 | VL3-21 | 8 | 3 |
| ADI-21049 | Site III | 0.102 | VH3-21 | VL1-40 | 7 | 3 |
| ADI-21050 | Site V | 0.000 | VH1-18 | VK2-30 | 10 | 7 |
| ADI-21051 | Unknown | 0.000 | VH4-61 | VK3-11 | 14 | 6 |
| ADI-21052 | site IV | 0.085 | VH1-18 | VL3-21 | 2 | 3 |
| ADI-21053 | Site I | 0.027 | VH4-31 | VK1-39 | 37 | 1 |
| ADI-21054 | Site IV | 0.000 | VH3-30 | VK1-5 | 21 | 9 |
| ADI-21055 | Site I | 0.110 | VH3-33 | VL1-44 | 12 | 10 |
| ADI-21056 | Site III | 0.020 | VH3-21 | VL1-40 | 15 | 6 |
| ADI-21057 | Site 0 | 0.000 | VH5-51 | VK3-15 | 13 | 1 |
| ADI-21058 | Site III | 0.000 | VH4-304 | VK3-15 | 20 | 3 |
| ADI-21059 | Unknown | 0.000 | VH5-51 | VK1-39 | 14 | 8 |
| ADI-21060 | Site III | 0.105 | VH3-11 | VL1-40 | 26 | 6 |
| ADI-21061 | Site I | 0.084 | VH1-69 | VL2-14 | 22 | 8 |
| ADI-21062 | Site I | 0.000 | VH3-21 | VK1-39 | 20 | 9 |
| ADI-21063 | Site V | 0.000 | VH3-64 | VK1-39 | 7 | 3 |
| ADI-21064 | Site V | 0.000 | VH1-18 | VK2-30 | 16 | 3 |
| ADI-21065 | Unknown | 0.000 | VH3-23 | VK3-20 | 7 | 2 |
| ADI-21067 | Site IV | 0.000 | VH4-34 | N/A | 11 | 0 |
| ADI-21068 | Site III | 0.021 | VH4-4 | VL1-40 | 19 | 3 |
| ADI-21069 | site IV | 0.000 | VH1-18 | VL3-21 | 16 | 5 |
| ADI-21070 | Site II | 0.000 | VH3-23 | VK3-15 | 12 | 3 |
| ADI-21071 | Site I | 0.019 | VH3-33 | VK1-39 | 14 | 7 |
| ADI-21072 | Site III | 0.010 | VH3-21 | VL1-40 | 16 | 3 |
| ADI-21073 | Site I | 0.000 | VH3-48 | VK1-39 | 18 | 8 |
| ADI-21075 | Site III | 0.021 | VH3-21 | VL1-40 | 17 | 2 |
| ADI-21076 | Site III | 0.015 | VH3-21 | VL1-40 | 16 | 7 |
| ADI-21077 | Site III | 0.018 | VH3-11 | VL1-40 | 9 | 2 |
| ADI-21078 | Site III | 0.017 | VH3-11 | VL1-40 | 10 | 5 |
| ADI-21079 | Site III | 0.064 | VH3-11 | VL1-40 | 5 | 1 |
| ADI-21080 | Site III | 0.006 | VH3-11 | VL1-40 | 16 | 2 |

TABLE 2-continued

Summary of antibody characteristics

| ADI-21081 | Site III | 0.031 | VH3-11 | VL1-40 | 12 | 5 |
| ADI-21082 | Site III | 0.004 | VH3-21 | VL1-40 | 13 | 5 |
| ADI-21083 | Site 0 | 0.101 | VH4-4 | VL2-11 | 12 | 6 |
| ADI-21084 | site IV | 0.100 | VH1-18 | VL3-21 | 19 | 6 |
| ADI-21085 | Site III | 0.167 | VH3-21 | VL1-40 | 9 | 6 |
| ADI-21086 | Site III | 0.024 | VH3-11 | VL1-40 | 16 | 4 |
| ADI-21087 | Unknown | 0.000 | VH3-48 | VK1-5 | 7 | 1 |
| ADI-21089 | Site III | 0.065 | VH3-21 | VL1-40 | 11 | 3 |
| ADI-21090 | Site IV | 0.000 | VH3-11 | VK3-15 | 28 | 6 |
| ADI-21091 | Site I | 0.005 | VH5-a | VL1-51 | 13 | 6 |

Figure 3D:
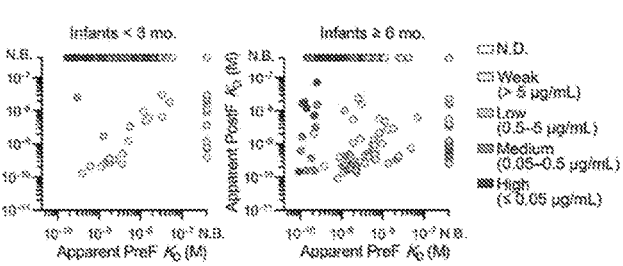
Figure 4B:
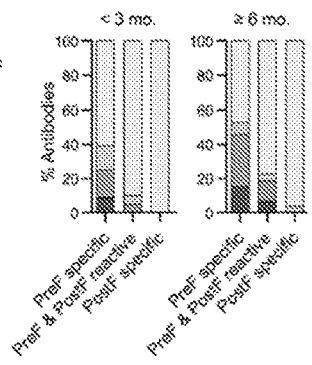
Figure 4C:
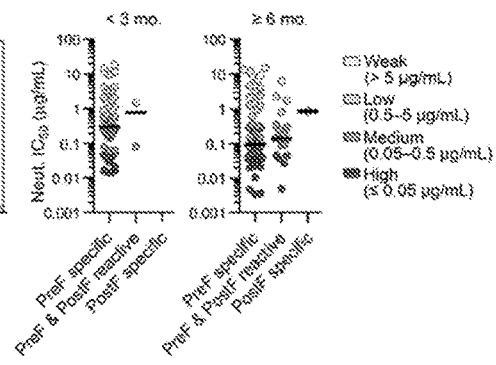

Analysis of the relationship between binding affinity and neutralization potency demonstrated that the majority of highly potent neutralizing antibodies bound with high apparent affinity to preF ($K_D$<1.0 nM) and failed to bind to postF (FIG. 3D). In addition, although approximately 20% of the neutralizing antibodies isolated from infants ≥6 mo. recognized both preF and postF, this type of neutralizing antibody was very rare in infants <3 mo. (FIGS. 3D and 4B), demonstrating that nearly all neutralizing antibodies in very young infants are preF-specific.

Figure 5A:
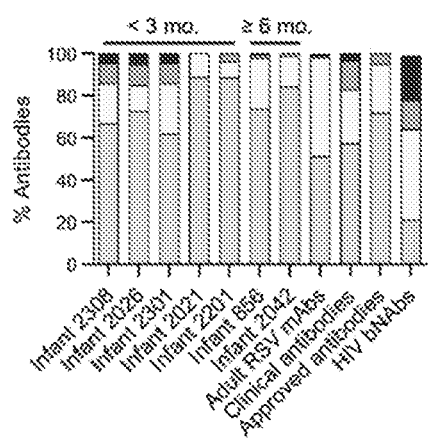
FIGS. 5A and 5B show that polyreactivity of infant antibodies decreases with increasing levels of somatic hypermutation. The percent of antibodies with high, medium, low, or undetectable polyreactivity is shown for each infant (FIG. 5A). Four panels of control antibodies, each with a variety of specificities, are shown for comparison: 364 RSV F-specific antibodies previously isolated from healthy adults, 138 antibodies currently in clinical trials, 39 antibodies that are approved for clinical use, and 14 broadly neutralizing HIV-1 antibodies. Infant antibodies are grouped according to the number of nucleotide mutations present in the VH gene (FIG. 5B).
Figure 5B:
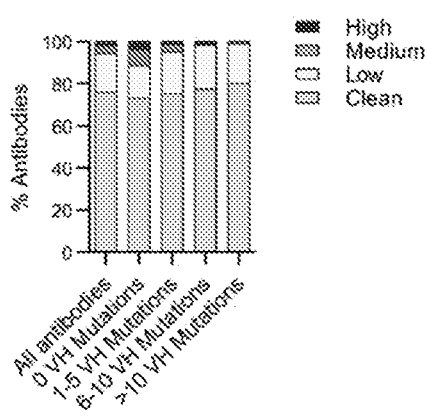

Next, the polyreactivity of the infant antibodies was assessed using a previously described assay (Jain et al., 2017; Kelly et al., 2015; Xu et al., 2013). Although the fraction of medium-to-highly polyreactive antibodies was relatively low (≤15%) for all infants, there was a higher frequency of polyreactive antibodies in the infants <3 mo. compared to the infants ≥6 mo. (FIG. 5A). This result could be related to differences in tolerance mechanisms in these two infant populations or to the higher frequency of antibodies containing little to no SHM in the younger infants. In support of the latter hypothesis, stratification of the antibodies based on their SHM levels showed that 12% of antibodies that lacked SHM displayed medium-to-high levels of polyreactivity, compared with only 2% of antibodies that contained >5 VH gene substitutions (FIG. 5B). This result is consistent with a prior study showing that the process of affinity maturation can result in decreased polyreactivity of human antibodies (Reed et al., 2016).

Figure 6A:
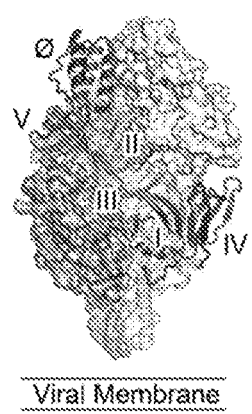
FIGS. 6A-6C show that infant responses are focused toward two antigenic sites with different neutralization sensitivities.
Figure 6B:
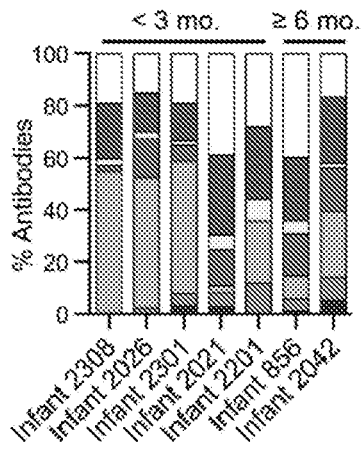

Infant Antibody Responses are Focused Primarily on Two Antigenic Sites that have Different Neutralization Sensitivity To define the epitopes targeted by the infant antibodies, each antibody was tested for competition with other known RSV F-specific antibodies and assigned to an antigenic site based on the resulting competition profile (FIGS. 6A and 6B). In the three youngest infants, responses were dominated by antibodies directed against site III, whereas in the other infants, a larger proportion of the responses were directed against site I, and in some cases site IV (FIG. 6B). The proportion of antibodies recognizing preF-specific sites Ø and V at the apex of the preF molecule was low, particularly in the three youngest infants. Interestingly, analysis of the VH and VL germline gene usage for the site I-directed antibodies revealed that over 25% of the antibodies that recognized site I utilized the VK1-39 light chain gene (FIG. 7A). Although these site I-directed antibodies utilized a variety of VH genes, many possessed a convergent CDR H3 motif, generated from recombination of the DH3-22 and JH-4 genes (FIG. 7C). In contrast, nearly 85% of antibodies that recognized site III utilized either the VH3-21/VL1-40 or the related VH3-11/VL1-40 germline gene pairing (FIG. 7B) and did not show evidence of a convergent CDR H3 sequence.

Figure 6C:
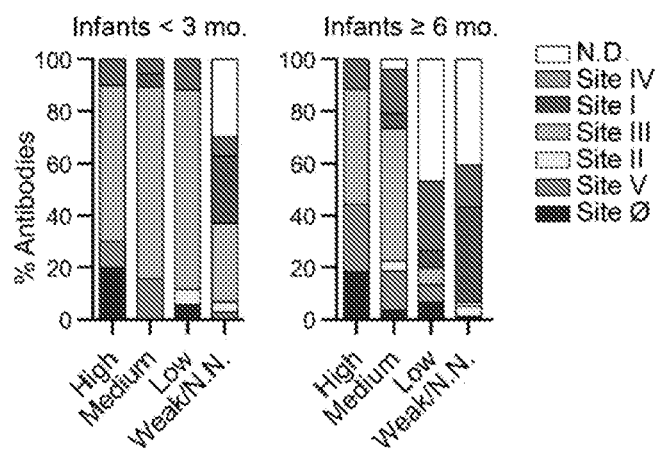

The majority of site III-directed antibodies were preF-specific and neutralizing, whereas antibodies that recognized site I preferentially bound to postF and tended to be weak or non-neutralizing (FIGS. 6C, 7D, and 7E). In infants <3 mo., 60% of antibodies that displayed highly potent neutralizing activity ($IC_{50}$<0.05 ug/ml) were directed against site III (FIG. 6C). Therefore, although antibodies against both sites I and III are readily elicited during natural RSV infection in infants, site III-directed antibodies can potently neutralize RSV whereas site I-directed antibodies are typically non-neutralizing.

Figure 8A:
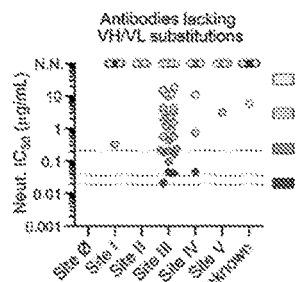
FIGS. 8A-8D show that germline antibodies targeting antigenic site III can potently neutralize RSV and are present in the naïve B cell repertoire.
Figure 8B:
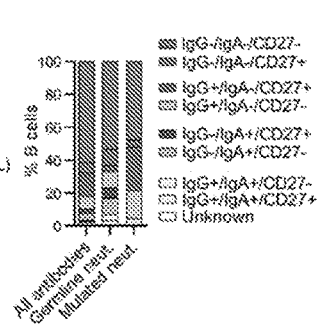
Figure 8C:
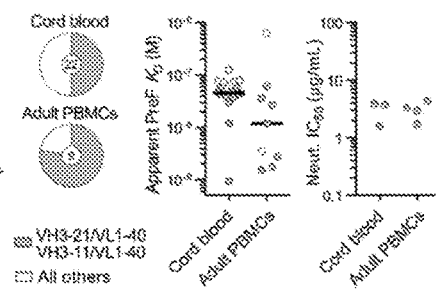
Figure 8D:

Site III-Directed Antibodies can Potently Neutralize RSV in the Absence of SHM and are Present in the Naïve B Cell Repertoire Next, the epitope specificities of the neutralizing antibodies that lacked SHM were analyzed (FIG. 8A). Of the 33 germline antibodies that displayed RSV-neutralizing activity, 27 targeted antigenic site III. Analysis of the index sort data revealed that approximately half of these antibodies originated from naïve b cells (IgG$^-$IgA$^-$CD27$^-$) and the other half originated from memory B cells that expressed IgG, IgA, or CD27 (FIG. 8B). The identification of neutralizing site III-directed antibodies from B cells that lacked both SHM and classical memory B cell markers led to an investigation of the occurrence of these antibody specificities in the naïve B cell repertoire. Therefore, 112 and 19 antibodies from RSV F-reactive cord blood B cells and adult naïve B cells, respectively, were cloned and expressed. Due to the low affinity of naïve B cell-derived antibodies, only 22/112 (20%) antibodies sorted from cord blood and 9/19 (47%) antibodies from adult naïve B cells bound with measurable affinity to RSV F as full-length IgGs. However, 11/22 (50%) and 7/9 (78%) of the RSV F binding antibodies from cord blood and adult naïve B cells, respectively, utilized VH3-21/VL1-40 or VH3-11/VL1-40 germline gene pairing (FIG. 8C). Of these 18 antibodies, the 13 with binding affinities that allowed for analysis in a competition assay were all shown to recognize antigenic site III (Table 3). Antibodies derived from naïve B cells isolated from cord blood or the PMBCs of healthy adults were tested for competition with three control IgGs and displayed profiles consistent with recognition of antigenic site III. Results are expressed as the fold reduction in antigen binding in the presence of saturating concentrations of competitor Fab relative to an antigen-only control. N.D.; not determined due to low binding affinity.

TABLE 3

Naïve B cells that utilize the VH3-21/VL1-40
and VH3-11/VL1-40 gene pairs recognize site III

| | | Competitor Fab | | |
|---|---|---|---|---|
| | | D25 (Antigenic site Ø) | MPE8 (Antigenic site III) | Motavizumab (Antigenic site II) |
| Control IgGs | D25 | 153 | 1 | 1 |
| | MPE8 | 1 | 228 | 20 |
| | Motavizumab | 1 | 1 | 39 |
| IgGs derived from naïve B cells | ADI-32365 | 8 | 11 | 19 |
| | ADI-28517 | 11 | 23 | 55 |
| | ADI-32361 | 7 | 50 | 169 |
| | ADI-32367 | 7 | 13 | 35 |
| | ADI-31917 | 3 | 69 | 190 |
| | ADI-31918 | 2 | 11 | 30 |
| | ADI-31919 | 1 | 55 | 159 |
| | ADI-28537 | 3 | 52 | 156 |
| | ADI-31921 | 3 | 37 | 112 |
| | ADI-32360 | 2 | 128 | 416 |
| | ADI-32362 | 3 | 117 | 370 |
| | ADI-32363 | 2 | 176 | 537 |
| | ADI-32366 | 3 | 61 | 10 |
| | ADI-28522 | N.D. | N.D. | N.D. |
| | ADI-31920 | N.D. | N.D. | N.D. |
| | ADI-28523 | N.D. | N.D. | N.D. |
| | ADI-28526 | N.D. | N.D. | N.D. |
| | ADI-28527 | N.D. | N.D. | N.D. |

The apparent binding affinities of these antibodies for preF were relatively high, ranging from 1.0-60 nM (FIG. 8C). In addition, approximately 40% of these site-III directed antibodies displayed neutralizing activity, with $IC_{50}$s ranging from 1.5-4.0 µg/mL (FIG. 8C). In contrast, none of the naïve B cell-derived antibodies that utilized other germline gene combinations showed detectable neutralizing activity (FIG. 8C). Collectively, these results indicate that site III-directed antibodies can neutralize RSV in the absence of SHM and that these types of antibodies are present in the naïve B cell repertoire.

A Site I-Directed Non-Neutralizing Antibody Recognizes postF Using a Convergent CDR H3 Motif and Germline-Encoded Regions of the VK1-39 Light Chain The structure of a site I-directed antibody, ADI-14359, in complex with postF was characterized to define the molecular determinants of the convergent antibody features (FIG. 9A) (Table 4).

TABLE 4

Crystallographic data collection and refinement statistics

| | Postfusion RSV F + ADI-14359 Fab | ADI-19425 Fab | Prefusion RSV F + ADI-19425 Fab + AM22 Fab |
|---|---|---|---|
| PDB ID | 6APB | 6APC | 6APD |
| Data collection | | | |
| Space group | $P2_12_12_1$ | $P2_12_12_1$ | $P4_12_12$ |
| Cell constants | | | |
| a, b, c (Å) | 88.5, 99.0, 323.3 | 61.2, 66.5, 126.0 | 229.5, 229.5, 304.1 |
| α, β, γ (°) | 90, 90, 90 | 90, 90, 90 | 90, 90, 90 |
| Wavelength (Å) | 1.1809 | 0.9792 | 0.9793 |
| Resolution (Å) | 51.1-3.0 (3.08-3.00) | 26.1-1.7 (1.73-1.70) | 50.9-4.1 (4.20-4.10) |
| Unique reflections | 57,978 (4,439) | 57,347 (2,940) | 64,175 (4,439) |
| $R_{merge}$ | 0.449 (1.662) | 0.069 (0.328) | 0.364 (1.545) |
| $R_{pim}$ | 0.177 (0.650) | 0.028 (0.153) | 0.108 (0.443) |
| I/σI | 5.2 (1.6) | 16.8 (4.2) | 6.3 (1.9) |
| $CC_{1/2}$ | 0.952 (0.564) | 0.998 (0.930) | 0.995 (0.609) |
| Completeness (%) | 100.0 (100.0) | 99.9 (99.4) | 99.9 (100.0) |
| Redundancy | 7.3 (7.4) | 6.8 (5.5) | 12.2 (13.0) |
| Wilson B-factors | 11.5 | 29.4 | 117.9 |
| Refinement | | | |
| Resolution (Å) | 51.1-3.0 (3.05-3.00) | 26.1-1.7 (1.73-1.70) | 50.9-4.1 (4.16-4.10) |
| Unique reflections | 57,820 (2,724) | 57,181 (2,645) | 64,084 (2,497) |
| $R_{work}/R_{free}$ (%) | 22.0/25.3 | 17.4/20.4 | 20.9/26.1 |
| No. atoms | | | |
| Protein | 13,264 | 3,233 | 30,005 |
| Ligand/ion | 42 | 10 | — |
| Water | — | 692 | — |

TABLE 4-continued

Crystallographic data collection and refinement statistics

| | Postfusion RSV F + ADI-14359 Fab | ADI-19425 Fab | Prefusion RSV F + ADI-19425 Fab + AM22 Fab |
|---|---|---|---|
| B-factors | | | |
| Protein | 37.2 | 15.9 | 167.2 |
| Ligand/ion | 76.5 | 21.3 | — |
| Water | — | 30.2 | — |
| R.m.s. deviations | | | |
| Bond lengths (Å) | 0.004 | 0.003 | 0.003 |
| Bond angles (°) | 0.91 | 0.667 | 0.632 |
| Ramachandran | | | |
| Favored (%) | 95.9 | 97.5 | 95.1 |
| Allowed (%) | 3.8 | 2.1 | 4.7 |
| Outliers (%) | 0.4 | 0.5 | 0.2 |

Values in parentheses are for the highest-resolution shell.

Figure 9C:
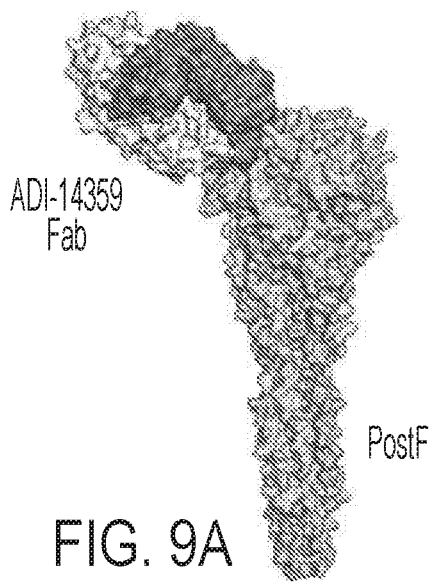
Figure 9C:
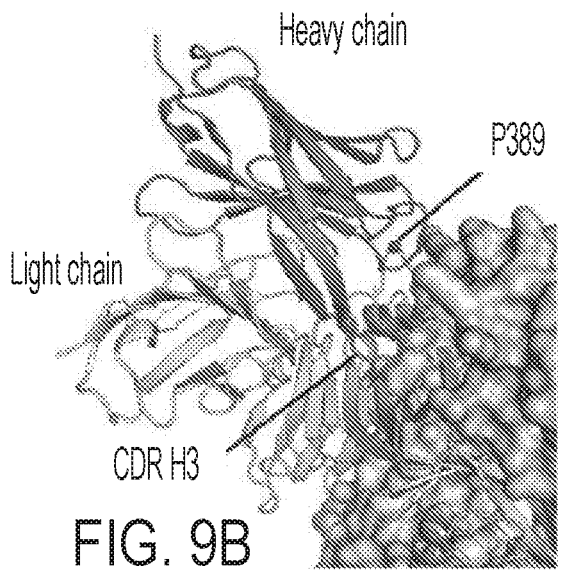
Figure 9C:
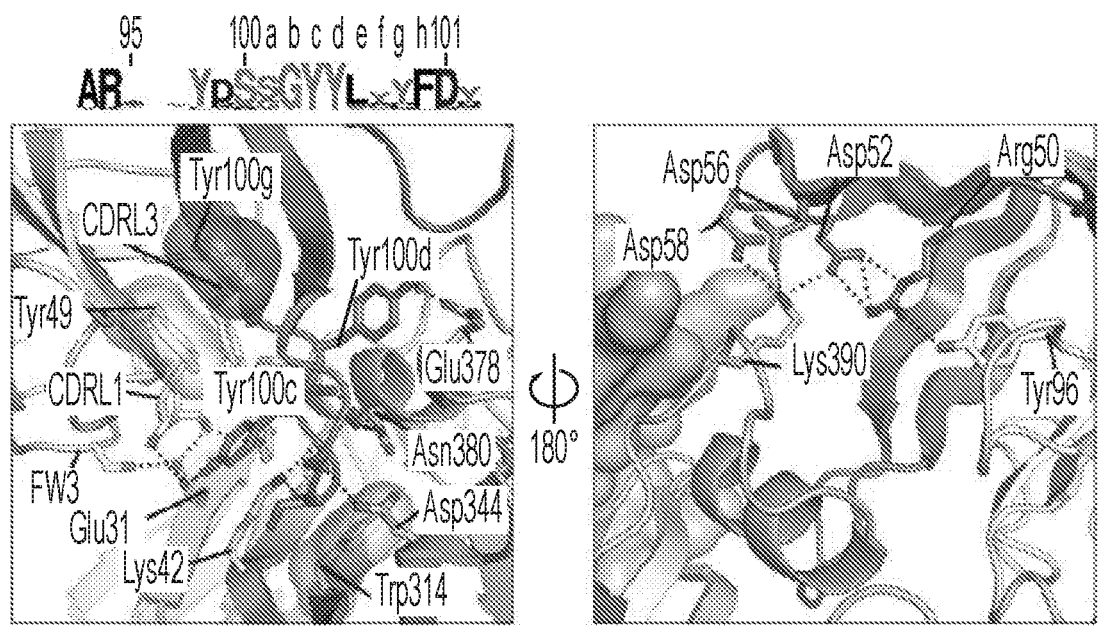

The structure revealed that the CDR H3, generated from the convergent usage of DH3-22/JH-4, is inserted into a small groove near the top of the postF trimer (FIG. 9B) and makes a number of hydrogen bonds with postF residues in and around this groove (FIG. 9C). CDR H3 residues Tyr100c and Tyr100d (Kabat numbering), which are uncommon in D genes other than DH3-22, form hydrogen bonds with postF residues Glu31 and Glu378, respectively, which are located on the ridge surrounding the site I groove. The tip of the CDR H3 loop is composed of three small amino acids that allow the loop to fit into the groove and make hydrogen bonds with residues Lys42, Asp344, and Asn380 of postF. These small residues also allow the CDR H3 to stack against Trp314, which is positioned at the floor of the groove. In addition, ADI-14359 heavy chain residue Tyr100g, which is unique to the JH4 gene, stacks against Tyr49 in the light chain, which may help properly orient the CDR H3.

Antibodies that utilized this convergent CDR H3 also showed a strong bias towards pairing with the VK1-39 light chain gene. Several germline-encoded residues within CDR L1 and the framework region 3 of VK1-39 form hydrogen bonds with Glu31 on postF (FIG. 9C). In addition, Tyr92 at the start of the CDR L3 is a unique feature of VK1-39, and forms a hydrogen bond with Ser35 on the F2 subunit of postF. The light chain of ADI-14359 is predicted to clash substantially with β22 of preF, which rearranges during the transition to postF to allow formation of the six-helix bundle (FIG. 10). Therefore, preferential binding to postF by this type of antibody is mediated by the light chain.

Figure 9D:
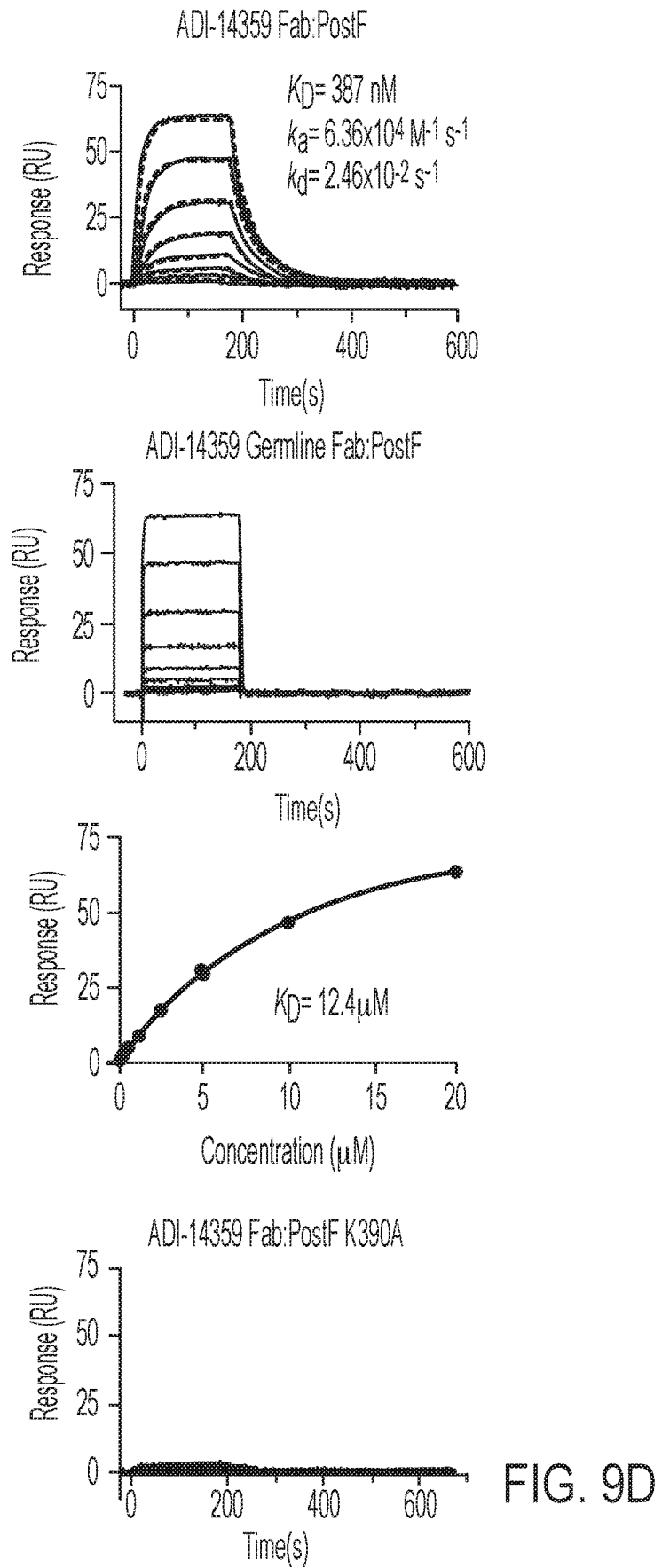
Figure 10A:
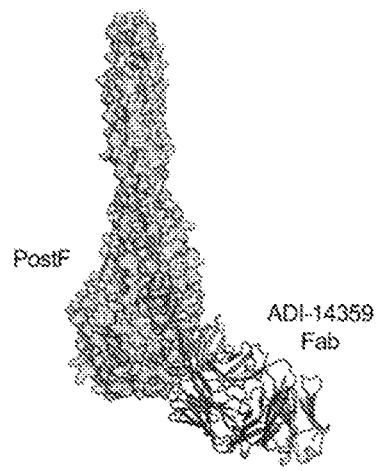
FIGS. 10A-10D show that the light chain mediates postF preference of ADI-14359. The crystal structure of ADI-14359 (VH2-70/VK1-39) in complex with postF is shown at a 180° rotation with respect to FIG. 9 (FIG. 10A). Two protomers of postF are shown as molecular surfaces and the third protomer and ADI-14359 are shown as ribbons. The ADI-14359 heavy chain is gray and the light chain is white. The position of the fused viral and host-cell membranes is shown for orientation. The predicted interaction between preF and ADI-14359 was predicted by aligning the unbound preF structure to the ADI-14359-bound postF structure (FIG. 10B). The unfused viral membrane is shown for orientation. A magnified view of the ADI-14359-postF interface (FIG. 10C). One protomer is shown in ribbons. The ADI-14359 light chain CDR1 and FW3 form hydrogen bonds with two residues on β1 (Glu31 and Tyr33). A magnified view of the predicted ADI-14359-preF interface (FIG. 10D). In preF, (322 blocks access to (31 and would clash with the ADI-14359 light chain FW3 and CDR1. In addition, Glu31 is rotated away from ADI-14359 in preF, which would prevent hydrogen bonding with this residue.
Figure 10B:
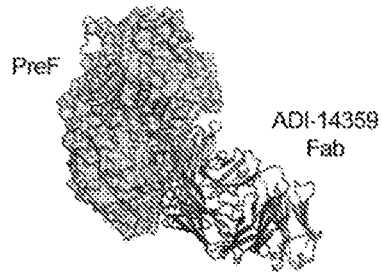
Figure 10C:
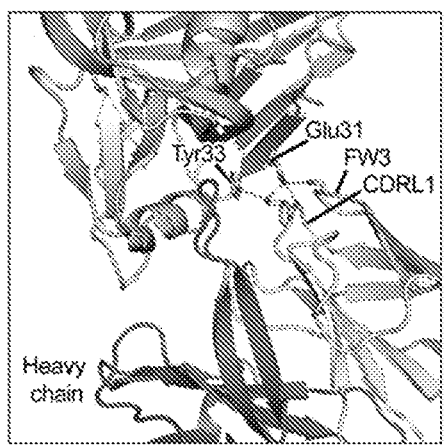
Figure 10D:
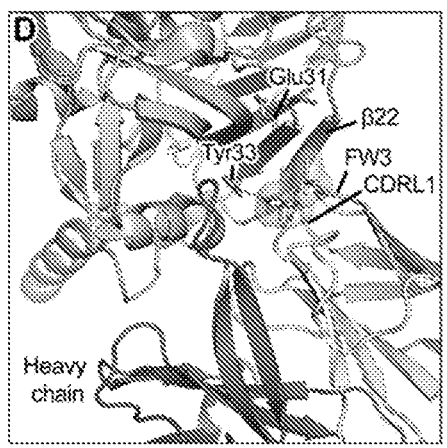

Although site I-directed antibodies did not show convergent VH gene usage, the heavy chain utilized by ADI-14359 also makes critical interactions with postF (FIG. 9C). The only residue that is mutated from germline in ADI-14359, Arg50, forms a salt bridge with Asp52 in the CDR H2 and appears to assist in coordinating the electrostatic interaction between Asp52, Asp56 and Asp58 of the CDR H2 with Lys390 on postF. Arg50 also forms a hydrogen bond with light chain residue Tyr96, a residue that is unique to the IGK-J2 gene utilized by ADI-14359. To investigate the contribution of these VH gene-mediated interactions to binding, the binding affinity of ADI-14359 Fab and the germline reverted variant (R50L) to postF was measured using surface plasmon resonance (SPR). This analysis revealed that the affinity of the germline reverted variant was reduced by more than 30-fold (FIG. 9D). Also, it was found that substitution of Lys390 on postF with alanine (K390A) almost entirely ablated ADI-14359 binding (FIG. 9D). The presence of three acidic residues in the CDR H2 therefore appears to be critical for the interaction of ADI-14359 with postF. However, the contribution of the CDR H2 to binding may vary among other members of this group, since many of the VH germlines utilized lack this acidic motif.

Figure 11A:
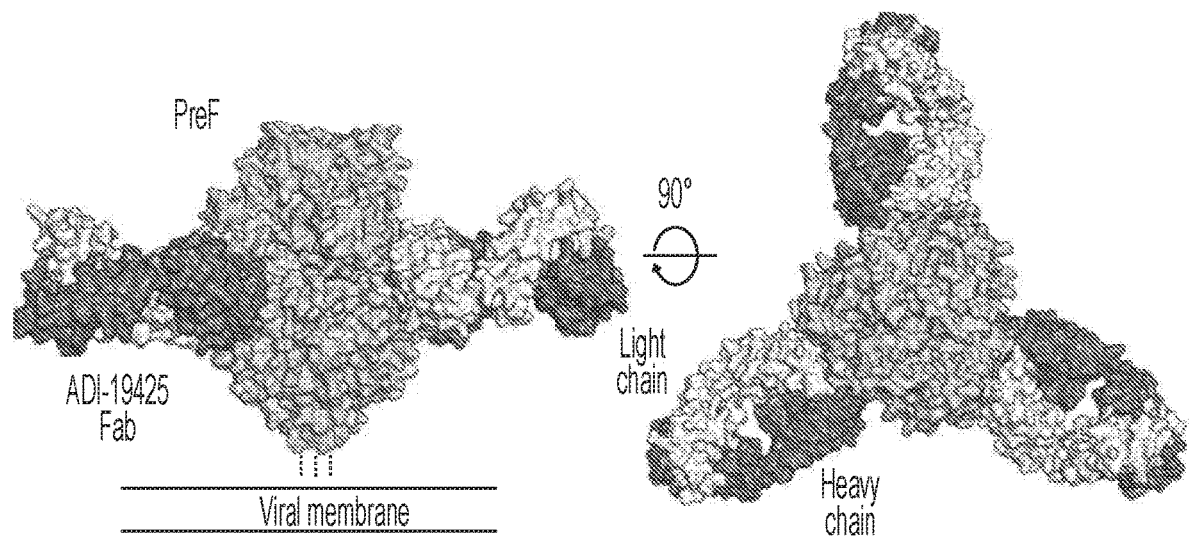
FIGS. 11A-11C show that neutralizing antibody ADI-19425 uses germline-encoded features for high-affinity binding to antigenic site III on preF.
Figure 11B:
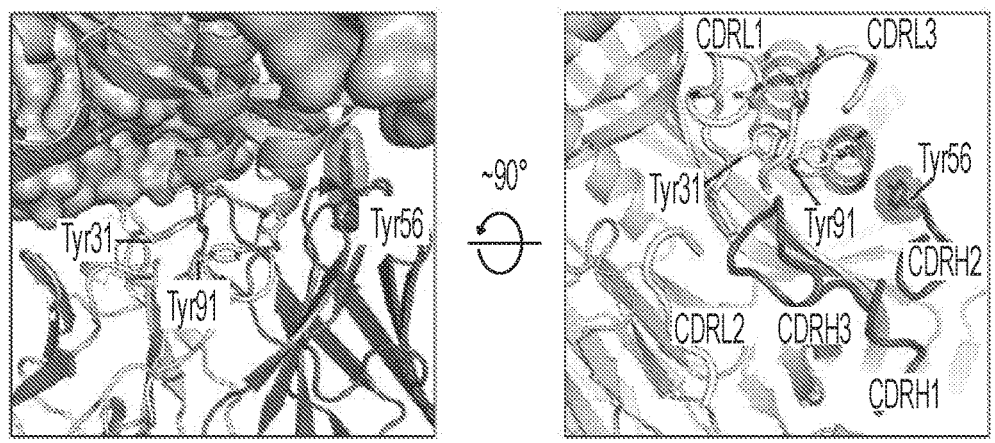
Figure 11C:
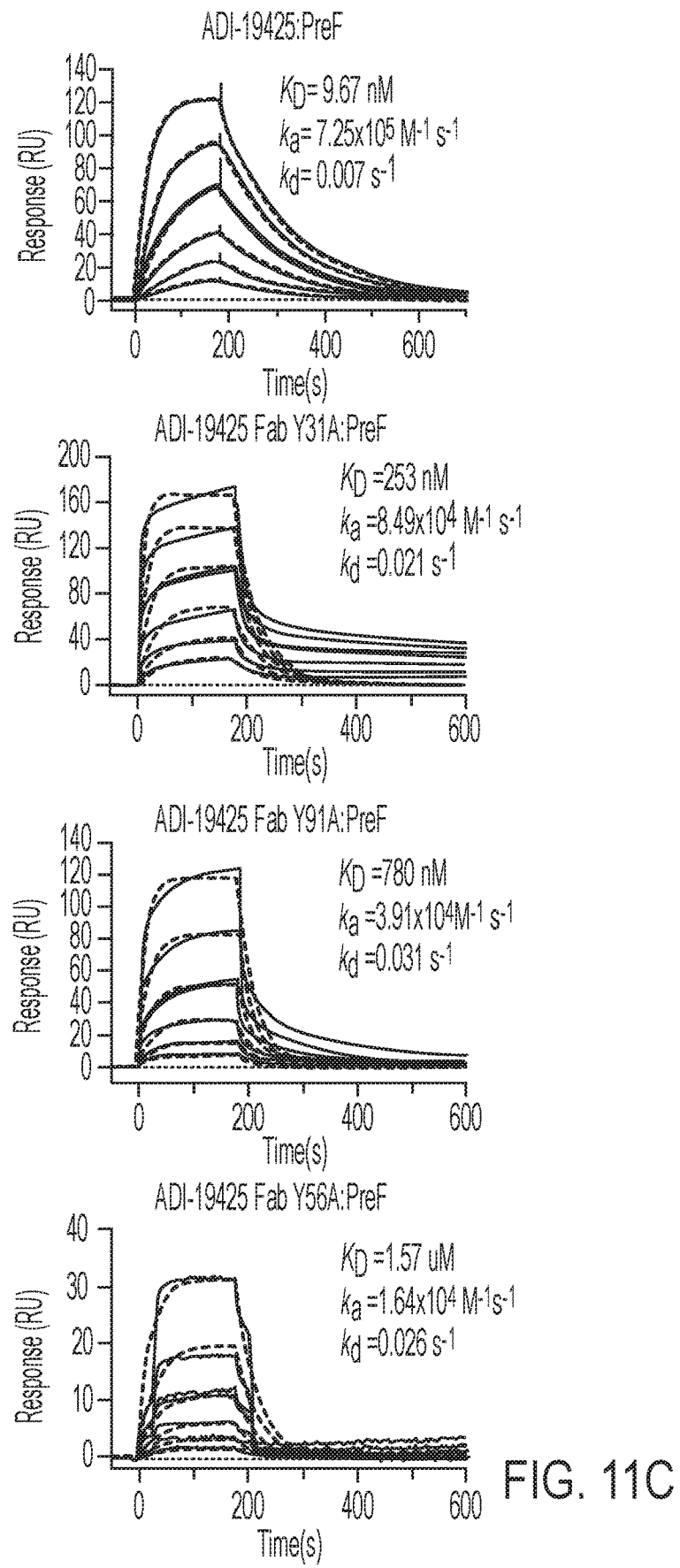
Figure 12A:
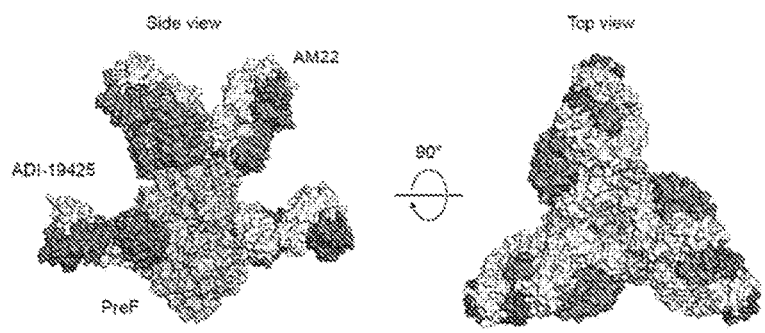
FIGS. 12A-12D show ADI-19425 and MPE8 utilize similar germline-encoded features to recognize preF. A ternary crystal structure of preF, 3 AM22 Fabs, and 3 ADI-19425 Fabs was generated (FIG. 12A, left and right panels). The right panel shows the same complex in the left panel, but rotated by 90° to show the view looking toward the viral membrane. Neutralization of two strains of RSV (A2 and B10895) by ADI-19425 IgG was measured using the fluorescence plate reader assay (FIG. 12B). The preF-bound MPE8 Fv was aligned to preF bound by ADI-19425 (FIG. 12C, left and right panels). The right panel is rotated by 90° relative to the left panel to show the top view. The MPE8 Fv is aligned to that of ADI-19425 (FIG. 12D, left and right panels). The right panel shows the binding interface between preF and ADI-19425, with the same orientation shown in FIG. 11B. The CDR loops are shown for both ADI-19425 and MPE8.
Figure 12B:
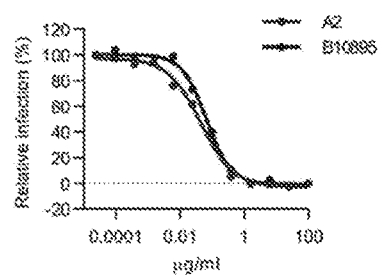

A Site III-Directed Neutralizing Antibody Utilizes Germline-Encoded Features of the VH3-21 and VL1-40 Genes for High-Affinity Recognition of preF To investigate the molecular basis of preferential germline gene pairing in antibodies targeting site III, the crystal structure of ADI-19425 bound to a preF-stabilized variant of RSV F (PR-DM) was determined (FIGS. 11A and 12A, Table 4) (Krarup et al., 2015). This antibody, which was isolated from a 2.8-month old infant, showed potent neutralizing activity despite lacking SHM (Table 2, FIG. 12B). The structure revealed that the majority of contacts between ADI-19425 and preF are formed by the light chain, particularly Tyr31 in CDR L1 and Tyr91 in CDR L3, both of which contact the loop connecting α6 to α7 (FIG. 11B). Tyr91 is the only residue in the CDR L3 that directly interacts with F, although contacts between Asp94 and Ser96 may play a role in positioning this loop and preventing a steric clash between ADI-19425 and antigenic site II (α6-α7) of RSV F. Consistent with the structural analysis, substitution of Tyr31 or Tyr91 with alanine resulted in greater than 20- or 80-fold reductions in affinity, respectively, as measured by SPR (FIG. 11C).

In addition to the contacts formed by the light chain, CDR H2 contains a stretch of five consecutive serine residues that form a network of hydrogen bonds with Asp310 on β6 of preF. Notably, the VH3-11 germline gene, which has 92% sequence identity with VH3-21, was utilized by site III-directed antibodies at a much lower frequency than VH3-21 (11% compared with 76%). One explanation for this could be the presence of a tyrosine residue directly following the polyserine motif in VH3-21, but not VH3-11. The structure shows that this residue (Tyr56) is buried in a small groove neighboring antigenic site II (FIG. 11B). Consistent with these observations, substitution of Tyr56 with alanine resulted in a more than 150-fold decrease in affinity (FIG. 11C). Interestingly, although the VH3-48 germline gene also contains the polyserine motif and is present in the naïve B cell repertoire at approximately the same frequency as VH3-11 (DeKosky et al., 2013), only a single site III-directed antibody (ADI-19440) that utilizes VH3-48/VL1-40 was isolated (see Table 2).

The structure also shows that Tyr56 of ADI-19425 is buried in a small groove neighboring antigenic site II on preF (FIG. 11B). Consistent with these observations, substitution of Tyr56 with alanine resulted in a more than 150-fold decrease in affinity (FIG. 11C).

Figure 12C:
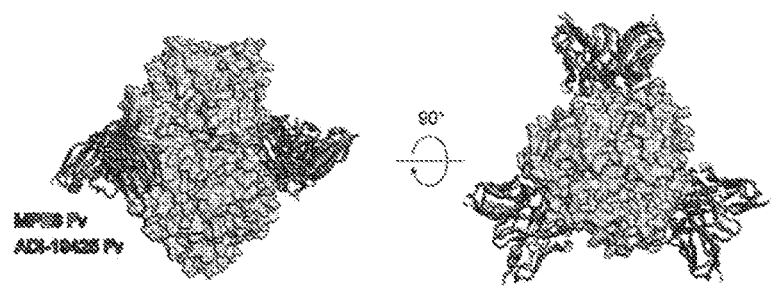
Figure 12D:
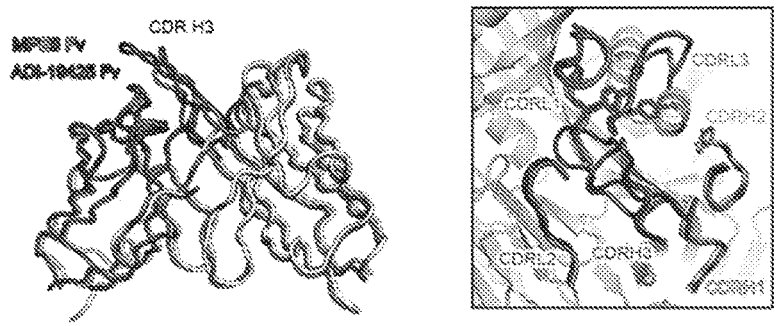

In contrast to the clear VH- and VL-specific features highlighted above, there were fewer restrictions on the sequences of the CDR H3s of site III antibodies, and sequence analysis demonstrated that the CDR H3s varied in length, with some preference towards usage of glycine, serine and tyrosine residues at positions 96-100c (FIG. 7C). The structure reveals that although the ADI-19425 CDR H3 buries approximately 250 Å of preF, it does not form hydrogen bonds or salt bridges with either protomer (FIG. 11B). Notably, the cross-neutralizing antibody MPEG, which has recently been structurally characterized (Wen et al., 2017), utilizes the $V_H3-21$ and $V_L1-40$ germline gene pair to recognize site III with a binding mode nearly identical to that of ADI-19425, despite substantial differences in the sequences of the two CDR H3s (FIGS. 12C and 12D). This is consistent with our observation that multiple CDR H3 sequences can be utilized by this family of antibodies to recognize preF.

Discussion

Although RSV causes substantial mortality in infants, little is known about the specificities and functional characteristics of the infant antibody response to natural RSV infection. Here, it is shown that infant antibody responses to RSV F differ substantially from those of healthy adults, not only in affinity and neutralization potency, but also in the patterns of epitope recognition. The infant responses were focused on two major regions of the RSV F trimer—antigenic sites I and III—neither of which are dominant in adult responses (Gilman et al., 2016). These differences were the most extreme in infants under three months of age, with infants older than six months exhibiting responses that began to resemble healthy adults. This observation is consistent with previous studies showing that the infant immune system begins to mature at around six months of age, but does not attain stable, adult-like characteristics until later in life, at around six years of age (IJspeert et al., 2016; Ridings et al., 1998).

The majority of antibodies that recognized antigenic site III utilized the same VH and VL germline gene pairing, but were not restricted in D- and J-gene usage. Importantly, a subset of these antibodies showed potent neutralizing activity despite containing little to no SHM. Approximately half of these antibodies were derived from memory B cells and the other half were derived from B cells that lacked surface expression of CD27, IgG and IgA, suggesting that they originated from naïve B cells.

Recent work has shown that polyclonal IgM antibodies purified from RSV naive infant sera are capable of neutralizing RSV and it was suggested that these antibodies may represent natural anti-RSV antibodies that react with the N- and O-linked glycans present on the RSV surface glycoproteins (Jans et al., 2016). However, unlike natural IgM antibodies—which rely on avidity, typically recognize common surface antigens, and exhibit some degree of polyreactivity (Panda and Ding, 2015)—the site III-directed antibodies described here bind with high affinity in an IgG backbone, specifically recognize an epitope on RSV F that lacks N-linked glycans, and generally show limited polyreactivity, suggesting that they are distinct from previously described natural antibodies. In addition, the presence of this class of antibodies in the memory compartment of older infants and adults indicates that these B cells can be activated in response to antigen exposure and undergo affinity maturation. Similar germline-mediated recognition in the adaptive immune response has also been described for other viral pathogens, including influenza (Ekiert et al., 2009; Kashyap et al., 2008; Sui et al., 2009; Throsby et al., 2008), hepatitis C virus (Bailey et al., 2017) and human cytomegalovirus (Thomson et al., 2008), and for bacterial pathogens such as *Staphylococcus aureus* (Yeung et al., 2016). The presence of functional germline antibodies in the human antibody repertoire has been proposed to serve as a type of innate humoral response to life-threatening pathogens that are likely to be encountered early in life (Lerner, 2011). The isolation of this class of antibodies from all seven infants studied here, as well as from cord blood B cells, adult naïve B cells, and memory B cells from previously characterized adult donors (Gilman et al., 2016), suggests that the naïve B cell precursors encoding these antibody specificities are likely present in most individuals. The results suggest that expansion of these cells may be a feasible goal for infant vaccination strategies (in contrast to, e.g., certain types of HIV-neutralizing antibodies, whose inferred germline precursors display limited reactivity with native HIV Env antigens only develop in a subset of HIV-1 infected individuals, and require complex vaccination strategies to elicit (Doria-Rose et al., 2010; Gray et al., 2011; Jardine et al., 2016; Sather et al., 2009; Simek et al., 2009; Sok et al., 2016; Yacoob et al., 2016)).

Antibody responses directed specifically against preF are associated with potent neutralization of RSV in human sera (Magro et al., 2012; Ngwuta et al., 2015), and monoclonal antibodies that bind exclusively to preF have been shown to be substantially more potent than antibodies that recognize both preF and postF (Corti et al., 2013; Gilman et al., 2016; Gilman et al., 2015; McLellan et al., 2013; Mousa et al., 2017). Interestingly, neutralizing antibodies that react with both preF and postF were identified in healthy adults and infants over 6 months old, but were almost entirely absent in the youngest infants analyzed here. Although postF antigens are capable of eliciting neutralizing antibodies that also bind to preF, their inability to elicit preF-specific antibodies would likely prove problematic for use in a young infant population. In addition, our results show that a large fraction of the infant antibody response (15-30%) is directed against antigenic site I, which is preferentially expressed on postF. Since antibodies targeting this site generally showed poor neutralizing activity, vaccination with a postF antigens could drive infant antibody responses toward ineffective recognition of RSV F. Recently, it was shown that formalin inactivated RSV (FI-RSV), the preparation that resulted in vaccine-enhanced disease when administered to infants in the 1960s, displays an abundance of postF on the surface of the virus (Killikelly et al., 2016). Although many factors contribute to the development of vaccine-enhanced disease (Acosta et al., 2015), the high abundance of postF on FI-RSV could result in the induction of high levels of site I-directed antibodies and a low fraction of neutralizing antibodies, which are properties previously associated with the formation of immune complexes that contribute to lung pathology in vaccine-enhanced illness (Murphy and Walsh, 1988; Polack et al., 2002).

An age-dependent increase in the response against antigenic sites Ø and V, which are both present near the apex of the preF trimer, was also observed. Although infant antibodies that targeted these epitopes tended to be potently neutralizing, they were present at low abundance in the responses analyzed here, particularly in infants under three months of age. These data suggest that although the presence of site Ø is likely important for generating neutralizing antibody responses later in life, eliciting a neutralizing response in young infants will likely depend on the presentation of antigenic site III. The observed differences in the dominant epitopes targeted by infant and adult responses provides a unique opportunity for prevention strategies that seek to combine passive and active immunization. For example, vaccines could be designed to preferentially elicit site III antibodies, which would not compete for binding with certain second-generation prophylactic antibodies that target antigenic site Ø, such as MEDI8897. In addition, antibodies elicited by a site-III-specific vaccine would not block access to the apex of the preF trimer on infectious virions, allowing the development of neutralizing antibodies directed against antigenic sites in this region to occur during natural RSV infection.

Materials & Methods

Human Subjects

Families of infants were approached at the time of hospitalization for documented RSV infection. At that point a Dartmouth Committee for the Protection of Human Subjects approved consent was signed to obtain 5-10 cc of blood approximately 1 month after discharge from the Children's Hospital at Dartmouth (CHaD). Families were contacted at the planned time for phlebotomy and arrangements made for blood to be drawn either at CHaD or at a medical facility closer to their home.

Plasma Neutralization Titers

Infant plasma samples were tested for RSV neutralization in microtiter assays using an RSV construct containing green fluorescent protein (GFP) and luciferase reporter genes (RSV-GFP1-Luc2, ViraTree). Hep2 cells were added to 96-well plates at a density of $1.8 \times 10^4$ cells per well in 100 µL of MEM with 2% FBS/1X penicillin-streptomycin solution (2% MEM) and allowed to adhere overnight at 37° C. On the day of the assay, plasma samples were serially diluted two-fold (1:4 to 1:128,000) in 2% MEM containing RSV-GFP1-Luc2 and incubated for 1 hr at 37° C. Culture media was aspirated from the Hep2 cells followed by the addition of 100 µL/well of the plasma-RSV-GFP1-Luc2 mixture to triplicate wells. Cultures were maintained at 37° C. for 24 hrs and luciferase expression was quantified in cell lysates using the Renilla-Glo® assay system (Promega). Relative light units (RLU) were measured on a BioTek Synergy 2 microplate reader. Neutralization is expressed as the reciprocal of the highest plasma dilution to yield a 60% reduction in RLU as compared to control wells with no added plasma Production of RSV F Sorting Probes To generate sorting probes with high avidity, and uniformly oriented F proteins, preF (DS-Cav1) and postF (F ΔFP) trimers with a single biotinylated C-terminal AviTag were produced before coupling to streptavidin-PE or -APC (Gilman et al., 2016).

Single B-Cell Sorting from Infants Less than 3 Months of Age

Peripheral blood mononuclear cells from RSV-infected infants were stained using anti-human IgG (BV605), IgA (FITC), CD27 (BV421), CD8 (PerCP-Cy5.5), CD14 (PerCP-Cy5.5), CD19 (PECy7), CD20 (PECy7) and a mixture of dual-labeled preF and postF tetramers (50 nM each). For naïve B cell sorting, cord blood or peripheral blood mononuclear cells were stained with anti-human IgG (BV605), IgM (FITC), CD27 (BV421), CD8 (PerCP-Cy5.5), CD14 (PerCP-Cy5.5), CD19 (PECy7), CD20 (PECy7) and a mixture of dual-labeled preF and postF tetramers (50 nM each). Tetramers were prepared fresh for each experiment. Single cells were sorted on a BD fluorescence-activated cell sorter Aria II into 96-well PCR plates (BioRad) containing 20 µL/well of lysis buffer [5 µL of 5X first strand cDNA buffer (Invitrogen), 0.25 µL RNaseOUT (Invitrogen), 1.25 µL dithiothreitol (Invitrogen), 0.625 µL NP-40 (New England Biolabs), and 12.6 µL dH2O]. Plates were immediately frozen on dry ice before storage at −80° C.

Amplification and Cloning of Antibody Variable Sequences

Single B cell PCR and cloning were performed as described previously (Gilman et al., 2016). Briefly, antibody variable genes were amplified by RT-PCR and PCR reactions using cocktails of IgG⁻ and IgA⁻ specific primers and then cloned into *S. cerevisiae* using the lithium acetate method for chemical transformation (Gietz and Schiestl, 2007). Transformation reactions contained 20 µL of unpurified heavy chain and light chain PCR product and 200 ng of digested heavy and light chain plasmids. After transformation, yeast cells were plated and individual yeast colonies were picked for sequencing and characterization.

Production of Full-Length Human Antibodies

Anti-RSV F IgGs were expressed in *S. cerevisiae* as described previously (Gilman et al., 2016). Briefly, *S. cerevisiae* cultures were grown in 24-well plates, and after six days of growth the yeast culture supernatants were harvested by centrifugation and purified over protein A.

High-Throughput Antibody Affinity Measurements

IgG binding affinities for preF and postF were determined by BLI measurements as described previously (Gilman et al., 2016).

Antibody Competition Experiments

Antibody competition assays were performed as previously described (Gilman et al., 2016). The degree of competition was analyzed by measuring the fold reduction in antigen binding in the presence of competitor Fab relative to an antigen-only control. Antibodies that showed a greater than five-fold reduction in binding in the presence of competitor Fab were considered competitors.

Polyreactivity Assay

Antibody polyreactivity was performed essentially as described previously (Jain et al., 2017). Yeast-expressed IgGs were incubated with biotinylated CHO cell membrane preparations and incubated on ice for 20 minutes. Cells were then washed and re-suspended in secondary antibody mix (Extravidin-R-PE, anti-human LC-FITC, and propidium iodide). The mixture was incubated on ice for 20 minutes and then washed twice with PBSF. Cells were then re-suspended in PBSF and run on a FACSCanto II (BD Biosciences). The mean fluorescence intensities of binding were normalized using control antibodies that display high, medium, or low polyreactivity to assess non-specific binding.

High-Throughput Fluorescence Plate Reader Neutralization Assay

A total of $2.4 \times 10^4$ HEp-2 cells/well in 30 µL culture medium were seeded in 384-well black optical-bottom plates (Nunc®384-well plates, Thermo Scientific). Antibodies were diluted four-fold starting at 100 µg/mL. An equal volume of recombinant mKate-RSV A2 or mKate-RSV B 18537 was then added and incubated at 37° C. for 1 hour. After incubation, 50 µl of the antibody-virus mixture was added to the HEp-2 cells and incubated at 37° C. for 22-24 hours. After incubation, the fluorescence intensity of each well was measured using a microplate reader at an excitation of 588 nm and an emission of 635 nm (SpectraMax Paradigm). Neutralization $IC_{50}$s were calculated using GraphPad Prism (GraphPad Software Inc.).

Production of ADI-14359, ADI-19425, and AM22 Fabs and Variants

Plasmids encoding the heavy and light chains of ADI-14359, ADI-19425 or AM22 were co-transfected at a 1:1 ratio into Expi293F cells. Point mutants were generated using MegaPrimer PCR and were expressed in FreeStyle 293-F cells. Fabs were purified using CaptureSelect IgG-CH1 affinity matrix (Life Technologies) and were further purified by size-exclusion chromatography on a Superdex 200 column (GE Healthcare).

Production of Protein Complexes for Crystallization

A mammalian expression vector encoding RSV F ΔFP (postF) with a C-terminal HRV 3C cleavage site, 8X HisTag and StrepTagII was transfected into FreeStyle 293-F cells and 5 µM kifunensine was added approximately 4 hours after transfection. The secreted protein was purified using Strep-Tactin resin (IBA), then treated with 10% (wt/wt) EndoH to remove N-linked glycans, followed by 10 U/mg of HRV 3C to remove tags. The protein was then purified by size-exclusion chromatography using a Superdex 200 column (GE) in buffer containing 2 mM Tris pH 8, 200 mM NaCl and 0.02% $NaN_3$.

To produce the ADI-14359 Fab-postF complex, purified F ΔFP was combined with a 1.5-fold molar excess of ADI-14359 Fab and incubated at room temperature for approximately 30 minutes. Excess Fab was separated from the complex by size-exclusion chromatography using a Superose 6 column (GE Healthcare Biosciences) in buffer containing 2 mM Tris pH 8, 200 mM NaCl and 0.02% $NaN_3$. The complex eluted with a retention volume indicative of a complex with 1-2 Fabs bound per postF trimer, suggesting that ADI-14359 Fab may bind sub-stoichiometrically to postF.

To produce the ADI-19425-AM22-preF ternary complex, purified PR-DM was combined with a 1.5-fold molar excess of both ADI-19425 Fab and AM22 Fab. Binding took place at room temperature for roughly 30 minutes before the ternary complex and excess Fab were separated by size-exclusion chromatography using a Superdex 200 column (GE Healthcare) in 2 mM Tris pH 8, 200 mM NaCl and 0.02% $NaN_3$.

Crystallization and Data Collection

The ADI-14359 Fab-postF complex was crystallized by the hanging-drop vapor-diffusion method by mixing 1.33 µL of protein at a concentration of 4.45 mg/mL with 0.67 µL of reservoir solution composed of 13% polyethylene glycol (PEG) 8000 and 0.43 M ammonium citrate pH 8.5. Cryopreservation was performed by hanging the looped crystal over a 1 M sodium chloride solution for approximately 2 minutes prior to plunge freezing in liquid nitrogen. Data were collected to 3.0 Å resolution at SSRL (Stanford Synchrotron Radiation Lightsource, National Accelerator Laboratory)

The unbound ADI-19425 Fab was initially crystallized using the sitting-drop vapor-diffusion method using 50 nL protein at 8.78 mg/ml and 100 nL reservoir solution containing 2.0 M ammonium sulfate and 0.1 M HEPES pH 7.5. These crystals were used to generate a seek solution and the final crystals were obtained using 50 nL protein at 8.78 mg/ml, 50 nL seed solution and 100 nL reservoir solution containing 1.5 M ammonium sulfate, 0.1 M sodium chloride, and 0.1 M Bis-Tris pH 6.5. Crystals were soaked in a solution of reservoir containing a final concentration of 2.5 M ammonium sulfate before being frozen in liquid nitrogen. Data were collected to 1.7 Å resolution at the SBC beamline 19-ID (Advanced Photon Source, Argonne National Laboratory).

The ADI-19425-AM22-preF ternary complex was crystallized by the sitting-drop vapor-diffusion method using 100 nL of protein solution at a concentration of 4.80 mg/mL and 100 nL of reservoir solution containing 0.1 M sodium citrate pH 5.5, 10% isopropanol and 10% PEG4000. Crystals were soaked in a cryoprotectant solution containing reservoir solution plus 15% 2R,3R-butanediol before being frozen in liquid nitrogen. Data were collected to 4.3 Å at the SBC beamline 19-ID (Advanced Photon Source, Argonne National Laboratory).

Structure Determination, Model Building and Refinement

Diffraction data were indexed and integrated using iMOSFLM (Battye et al., 2011) and merged and scaled with AIMLESS (Evans and Murshudov, 2013). Molecular replacement solutions were obtained with PHASER (McCoy et al., 2007) and the structures were refined using PHENIX (Adams et al., 2002) and built manually using Coot (Emsley and Cowtan, 2004). Software used for processing and visualization of X-ray diffraction data was curated by SBGrid and accessed using the CCP4i interface (Collaborative Computational Project, 1994; Morin et al., 2013; Potterton et al., 2003). Data collection and refinement statistics for the three crystal structures are presented in Table 2.

The ADI-14359-postF complex formed crystals in space group $P2_12_12_1$ and a molecular replacement solution was found using the previously solved postF structure (PDB ID: 3RRT), the heavy chain from 2D1 Fab (PDB ID: 3QHZ), and the light-chain from 5-51/O12 Fab (PDB ID: 4KMT) as search models. The asymmetric unit contained one postF trimer with only one ADI-14359 Fab bound per trimer. The model was built manually in Coot and refined in PHENIX using non-crystallographic symmetry (NCS) and reference model restraints to an Rwork/Rfree of 22.0/25.3%.

The unbound ADI-19425 Fab also formed crystals in P212121, and the heavy chain from MJ5 Fab (PDB ID: 3EYQ) and the light chain from LDLR competitive Fab (PDB ID: 3H42) were used as search models in molecular replacement. The structure was manually built in Coot and refined in PHENIX to an Rwork/Rfree of 17.4/20.4%. The ADI-19425-AM22-preF complex formed crystals in space group P41212 and a molecular replacement solution was found using the refined structures of the unbound ADI-19425 Fab and the complex of preF bound to AM22 Fab as search ensembles. The asymmetric unit contained a single preF trimer bound by three molecules of AM22 Fab and three molecules of 19425 Fab. The model was built manually in Coot and refined in PHENIX using non-crystallographic symmetry (NCS) and reference model restraints to an Rwork/Rfree of 22.2/25.5%.

Fab Affinity Measurements for ADI-14359, ADI-19425, and Variants

The affinity of ADI-14359 Fab for postF was measured using surface plasmon resonance (SPR). Purified postF (RSV F ΔFP) with a C-terminal HRV 3C cleavage site, 8X HisTag and StrepTagII was captured on the sample flow cell of an NTA sensor chip to approximately 115 RU per cycle using a Biacore X100 (GE Healthcare). The NTA chip was regenerated between each cycle with 0.35 M EDTA followed by 0.5 mM $NiCl_2$. A buffer-only reference sample (HBS-P+pH 8) was injected over both flow cells, followed by a 2-fold serial dilution of ADI-14359 Fab from 800 nM to 6.25 nM, starting with the lowest concentration, and a duplication of the 100 nM sample. The data were double-reference subtracted, then fit to a 1:1 binding model using Scrubber. Binding of ADI-14359 Fab to the postF K390A variant was measured in a similar manner, with capture of approximately 100 RU per cycle and injection of a buffer-only reference, followed by a 2-fold serial dilution of Fab from 1.6 µM to 6.25 nM, with a duplication of the 100 nM concentration. The data were double-reference subtracted, but the total response was too low to allow an affinity to be calculated. For the germline variant of ADI-14359 (R50L), approximately 115 RU of postF was captured on the NTA chip before injection of a buffer-only reference, followed by a 2-fold serial dilution of ADI-14359 R50L Fab from 20 µM to 78 nM. The data were double reference subtracted and fit using a steady-state affinity model in Scrubber.

Similar SPR experiments were performed to measure the binding between ADI-19425 Fab and preF. Purified preF (DS-Cav1) with a C-terminal 8X HisTag and AviTag was captured on the sample flow cell of an NTA sensor chip to approximately 150 RU. A buffer-only reference sample (HBS-P+pH 8.0) was injected over both the sample and reference flow cells, followed by a 2-fold serial dilution of ADI-19425 Fab from 40 nM to 1.25 nM, with a duplication of the 10 nM concentration. For the ADI-19425 Fab variants (heavy chain Y56A, light chain Y31A, and light chain Y91A), roughly 150 RU of preF was captured on the NTA chip before the injection of a buffer-only reference, followed by a 2-fold serial dilution of ADI-19425 Fab variant from 1000 nM to 31.25 nM, with a duplication of the 250 nM concentration. The data were double reference subtracted and fit using a 1:1 binding model in Scrubber.

Data Resources

Antibody sequences will be deposited in GenBank. Atomic coordinates and structure factors for the 14359-postF complex structure, the unbound 19425 Fab, and the 19425-AM22-preF complex structure have been deposited with the Protein Data Bank under accession codes 6APB, 6APC, and 6APD.

REFERENCES

All references cited herein including, without limitation, patents, patent applications, and non-patent references and publications referenced throughout, are hereby expressly incorporated by reference in their entireties for all purposes.

Acosta, P. L., Caballero, M. T., and Polack, F. P. (2015). Brief History and Characterization of Enhanced Respiratory Syncytial Virus Disease. Clin Vaccine Immunol 23, 189-195.

Adams, P. D., Grosse-Kunstleve, R. W., Hung, L. W., Ioerger, T. R., McCoy, A. J., Moriarty, N. W., Read, R. J., Sacchettini, J. C., Sauter, N. K., and Terwilliger, T. C. (2002). PHENIX: building new software for automated crystallographic structure determination. Acta Crystallogr D Biol Crystallogr 58, 1948-1954.

Anderson, L. J., Dormitzer, P. R., Nokes, D. J., Rappuoli, R., Roca, A., and Graham, B. S. (2013). Strategic priorities for respiratory syncytial virus (RSV) vaccine development. Vaccine 31 Suppl 2, B209-215.

Anderson, L. J., Hierholzer, J. C., Stone, Y. O., Tsou, C., and Fernie, B. F. (1986). Identification of epitopes on respiratory syncytial virus proteins by competitive binding immunoassay. J Clin Microbiol 23, 475-480.

Bailey, J. R., Flyak, A. I., Cohen, V. J., Li, H., Wasilewski, L. N., Snider, A. E., Wang, S., Learn, G. H., Kose, N., Loerinc, L., et al. (2017). Broadly neutralizing antibodies with few somatic mutations and hepatitis C virus clearance. JCI Insight 2.

Battles, M. B., Langedijk, J. P., Furmanova-Hollenstein, P., Chaiwatpongsakorn, S., Costello, H. M., Kwanten, L., Vranckx, L., Vink, P., Jaensch, S., Jonckers, T. H., et al. (2016). Molecular mechanism of respiratory syncytial virus fusion inhibitors. Nat Chem Biol 12, 87-93.

Battye, T. G., Kontogiannis, L., Johnson, O., Powell, H. R., and Leslie, A. G. (2011). iMOSFLM: a new graphical interface for diffraction-image processing with MOSFLM. Acta Crystallogr D Biol Crystallogr 67, 271-281.

Beeler, J. A., and van Wyke Coelingh, K. (1989). Neutralization epitopes of the F glycoprotein of respiratory syncytial virus: effect of mutation upon fusion function. J Virol 63, 2941-2950.

Bornholdt, Z. A., Turner, H. L., Murin, C. D., Li, W., Sok, D., Souders, C. A., Piper, A. E., Goff, A., Shamblin, J. D., Wollen, S. E., et al. (2016). Isolation of potent neutralizing antibodies from a survivor of the 2014 Ebola virus outbreak. Science 351, 1078-1083.

Chin, J., Magoffin, R. L., Shearer, L. A., Schieble, J. H., and Lennette, E. H. (1969). Field evaluation of a respiratory syncytial virus vaccine and a trivalent parainfluenza virus vaccine in a pediatric population. Am J Epidemiol 89, 449-463.

Collaborative Computational Project, N. (1994). The CCP4 suite: programs for protein crystallography. Acta Crystallogr D Biol Crystallogr 50, 760-763.

Corti, D., Bianchi, S., Vanzetta, F., Minola, A., Perez, L., Agatic, G., Guarino, B., Silacci, C., Marcandalli, J., Marsland, B. J., et al. (2013). Cross-neutralization of four paramyxoviruses by a human monoclonal antibody. Nature 501, 439-443.

Crooks, G. E., Hon, G., Chandonia, J. M., and Brenner, S. E. (2004). WebLogo: a sequence logo generator. Genome Res 14, 1188-1190.

DeKosky, B. J., Ippolito, G. C., Deschner, R. P., Lavinder, J. J., Wine, Y., Rawlings, B. M., Varadarajan, N., Giesecke, C., Dorner, T., Andrews, S. F., et al. (2013). High-throughput sequencing of the paired human immunoglobulin heavy and light chain repertoire. Nat Biotechnol 31, 166-169.

Doria-Rose, N. A., Klein, R. M., Daniels, M. G., O'Dell, S., Nason, M., Lapedes, A., Bhattacharya, T., Migueles, S. A., Wyatt, R. T., Korber, B. T., et al. (2010). Breadth of human immunodeficiency virus-specific neutralizing activity in sera: clustering analysis and association with clinical variables. J Virol 84, 1631-1636.

Ekiert, D. C., Bhabha, G., Elsliger, M. A., Friesen, R. H., Jongeneelen, M., Throsby, M., Goudsmit, J., and Wilson, I. A. (2009). Antibody recognition of a highly conserved influenza virus epitope. Science 324, 246-251.

Emsley, P., and Cowtan, K. (2004). Coot: model-building tools for molecular graphics. Acta Crystallogr D Biol Crystallogr 60, 2126-2132.

Esposito, S., Scarselli, E., Lelii, M., Scala, A., Vitelli, A., Capone, S., Fornili, M., Biganzoli, E., Orenti, A., Nicosia, A., et al. (2016). Antibody response to respiratory syncytial virus infection in children <18 months old. Hum Vaccin Immunother 12, 1700-1706.

Evans, P. R., and Murshudov, G. N. (2013). How good are my data and whatis the resolution? Acta Crystallogr D Biol Crystallogr 69, 1204-1214.

Fuentes, S., Coyle, E. M., Beeler, J., Golding, H., and Khurana, S. (2016). Antigenic Fingerprinting following Primary RSV Infection in Young Children Identifies Novel Antigenic Sites and Reveals Unlinked Evolution of Human Antibody Repertoires to Fusion and Attachment Glycoproteins. PLoS Pathog 12, e1005554.

Fulginiti, V. A., Eller, J. J., Sieber, O. F., Joyner, J. W., Minamitani, M., and Meiklejohn, G. (1969). Respiratory virus immunization. I. A field trial of two inactivated respiratory virus vaccines; an aqueous trivalent parainfluenza virus vaccine and an alum-precipitated respiratory syncytial virus vaccine. Am J Epidemiol 89, 435-448.

Gans, H., Yasukawa, L., Rinki, M., DeHovitz, R., Forghani, B., Beeler, J., Audet, S., Maldonado, Y., and Arvin, A. M. (2001). Immune responses to measles and mumps vaccination of infants at 6, 9, and 12 months. J Infect Dis 184, 817-826.

Garcia-Barreno, B., Palomo, C., Penas, C., Delgado, T., Perez-Brena, P., and Melero, J. A. (1989). Marked differences in the antigenic structure of human respiratory syncytial virus F and G glycoproteins. J Virol 63, 925-932.

Gietz, R. D., and Schiestl, R. H. (2007). High-efficiency yeast transformation using the LiAc/SS carrier DNA/PEG method. Nat Protoc 2, 31-34.

Gilman, M. S., Castellanos, C. A., Chen, M., Ngwuta, J. O., Goodwin, E., Moin, S. M., Mas, V., Melero, J. A., Wright, P. F., Graham, B. S., et al. (2016). Rapid profiling of RSV antibody repertoires from the memory B cells of naturally infected adult donors. Sci Immunol 1.

Gilman, M. S., Moin, S. M., Mas, V., Chen, M., Patel, N. K., Kramer, K., Zhu, Q., Kabeche, S. C., Kumar, A., Palomo, C., et al. (2015). Characterization of a Prefusion-Specific Antibody That Recognizes a Quaternary, Cleavage-Dependent Epitope on the RSV Fusion Glycoprotein. PLoS Pathog 11, e1005035.

Glezen, W. P., Taber, L. H., Frank, A. L., and Kasel, J. A. (1986). Risk of primary infection and reinfection with respiratory syncytial virus. Am J Dis Child 140, 543-546.

Graham, B. S. (2017). Vaccine development for respiratory syncytial virus. Curr Opin Virol 23, 107-112.

Gray, E. S., Madiga, M. C., Hermanus, T., Moore, P. L., Wibmer, C. K., Tumba, N. L., Werner, L., Mlisana, K., Sibeko, S., Williamson, C., et al. (2011). The neutralization breadth of HIV-1 develops incrementally over four years and is associated with CD4+ T cell decline and high viral load during acute infection. J Virol 85, 4828-4840.

Griffin, M. P., Khan, A. A., Esser, M. T., Jensen, K., Takas, T., Kankam, M. K., Villafana, T., and Dubovsky, F. (2017). Safety, Tolerability, and Pharmacokinetics of MEDI8897, the Respiratory Syncytial Virus Prefusion F-Targeting Monoclonal Antibody with an Extended Half-Life, in Healthy Adults. Antimicrob Agents Chemother 61.

Group, T. I.-R. S. (1998). Palivizumab, a humanized respiratory syncytial virus monoclonal antibody, reduces hospitalization from respiratory syncytial virus infection in high-risk infants. Pediatrics 102, 531-537.

Hall, C. B., Walsh, E. E., Long, C. E., and Schnabel, K. C. (1991). Immunity to and frequency of reinfection with respiratory syncytial virus. J Infect Dis 163, 693-698.

Henderson, F. W., Collier, A. M., Clyde, W. A., Jr., and Denny, F. W. (1979). Respiratory-syncytial-virus infections, reinfections and immunity. A prospective, longitudinal study in young children. N Engl J Med 300, 530-534.

Homaira, N., Rawlinson, W., Snelling, T. L., and Jaffe, A. (2014). Effectiveness of Palivizumab in Preventing RSV Hospitalization in High Risk Children: A Real-World Perspective. Int J Pediatr 2014, 571609.

Huang, K., Incognito, L., Cheng, X., Ulbrandt, N.D., and Wu, H. (2010). Respiratory syncytial virus-neutralizing monoclonal antibodies motavizumab and palivizumab inhibit fusion. J Virol 84, 8132-8140.

IJspeert, H., van Schouwenburg, P. A., van Zessen, D., Pico-Knijnenburg, I., Driessen, G. J., Stubbs, A. P., and van der Burg, M. (2016). Evaluation of the Antigen-Experienced B-Cell Receptor Repertoire in Healthy Children and Adults. Front Immunol 7, 410.

Jain, T., Sun, T., Durand, S., Hall, A., Houston, N. R., Nett, J. H., Sharkey, B., Bobrowicz, B., Caffry, I., Yu, Y., et al. (2017). Biophysical properties of the clinical-stage antibody landscape. Proc Natl Acad Sci USA 114, 944-949.

Jans, J., Pettengill, M., Kim, D., van der Made, C., de Groot, R., Henriet, S., de Jonge, M. I., Ferwerda, G., and Levy, 0. (2016). Human newborn B cells mount an interferon-alpha/beta receptor-dependent humoral response to respiratory syncytial virus. J Allergy Clin Immunol.

Jardine, J. G., Kulp, D. W., Havenar-Daughton, C., Sarkar, A., Briney, B., Sok, D., Sesterhenn, F., Ereno-Orbea, J., Kalyuzhniy, O., Deresa, I., et al. (2016). HIV-1 broadly neutralizing antibody precursor B cells revealed by germline-targeting immunogen. Science 351, 1458-1463.

Kamal-Bahl, S., Doshi, J., and Campbell, J. (2002). Economic analyses of respiratory syncytial virus immuno-prophylaxis in high-risk infants: a systematic review. Arch Pediatr Adolesc Med 156, 1034-1041.

Kapikian, A. Z., Mitchell, R. H., Chanock, R. M., Shvedoff, R. A., and Stewart, C. E. (1969). An epidemiologic study of altered clinical reactivity to respiratory syncytial (RS) virus infection in children previously vaccinated with an inactivated RS virus vaccine. Am J Epidemiol 89, 405-421.

Kashyap, A. K., Steel, J., Oner, A. F., Dillon, M. A., Swale, R. E., Wall, K. M., Perry, K. J., Faynboym, A., Ilhan, M., Horowitz, M., et al. (2008). Combinatorial antibody libraries from survivors of the Turkish H5N1 avian influenza outbreak reveal virus neutralization strategies. Proc Natl Acad Sci USA 105, 5986-5991.

Kelly, R. L., Sun, T., Jain, T., Caffry, I., Yu, Y., Cao, Y., Lynaugh, H., Brown, M., Vasquez, M., Wittrup, K. D., et al. (2015). High throughput cross-interaction measures for human IgG1 antibodies correlate with clearance rates in mice. MAbs, 0.

Killikelly, A. M., Kanekiyo, M., and Graham, B. S. (2016). Pre-fusion F is absent on the surface of formalin-inactivated respiratory syncytial virus. Sci Rep 6, 34108.

Kim, H. W., Canchola, J. G., Brandt, C. D., Pyles, G., Chanock, R. M., Jensen, K., and Parrott, R. H. (1969). Respiratory syncytial virus disease in infants despite prior administration of antigenic inactivated vaccine. Am J Epidemiol 89, 422-434.

Krarup, A., Truan, D., Furmanova-Hollenstein, P., Bogaert, L., Bouchier, P., Bisschop, I. J., Widjojoatmodjo, M. N., Zahn, R., Schuitemaker, H., McLellan, J. S., et al. (2015). A highly stable prefusion RSV F vaccine derived from structural analysis of the fusion mechanism. Nat Commun 6, 8143.

Kristjansson, S., Bjarnarson, S. P., Wennergren, G., Palsdottir, A. H., Arnadottir, T., Haraldsson, A., and Jonsdottir, I. (2005). Respiratory syncytial virus and other respiratory viruses during the first 3 months of life promote a local TH2-like response. J Allergy Clin Immunol 116, 805-811.

Lambert, D. M., Barney, S., Lambert, A. L., Guthrie, K., Medinas, R., Davis, D. E., Bucy, T., Erickson, J., Merutka, G., and Petteway, S. R., Jr. (1996). Peptides from conserved regions of paramyxovirus fusion (F) proteins are potent inhibitors of viral fusion. Proc Natl Acad Sci USA 93, 2186-2191.

Lambert, L., Sagfors, A. M., Openshaw, P. J., and Culley, F. J. (2014). Immunity to RSV in Early-Life. Front Immunol 5, 466.

Legg, J. P., Hussain, I. R., Warner, J. A., Johnston, S. L., and Warner, J. O. (2003). Type 1 and type 2 cytokine imbalance in acute respiratory syncytial virus bronchiolitis. Am J Respir Crit Care Med 168, 633-639.

Lerner, R. A. (2011). Rare antibodies from combinatorial libraries suggests an S.O.S. component of the human immunological repertoire. Mol Biosyst 7, 1004-1012.

Magro, M., Mas, V., Chappell, K., Vazquez, M., Cano, O., Luque, D., Terron, M. C., Melero, J. A., and Palomo, C. (2012). Neutralizing antibodies against the preactive form of respiratory syncytial virus fusion protein offer unique possibilities for clinical intervention. Proc Natl Acad Sci U S A 109, 3089-3094.

McCoy, A. J., Grosse-Kunstleve, R. W., Adams, P. D., Winn, M. D., Storoni, L. C., and Read, R. J. (2007). Phaser crystallographic software. J Appl Crystallogr 40, 658-674.

McLellan, J. S., Chen, M., Chang, J. S., Yang, Y., Kim, A., Graham, B. S., and Kwong, P. D. (2010a). Structure of a major antigenic site on the respiratory syncytial virus fusion glycoprotein in complex with neutralizing antibody 101F. J Virol 84, 12236-12244.

McLellan, J. S., Chen, M., Kim, A., Yang, Y., Graham, B. S., and Kwong, P. D. (2010b).

Structural basis of respiratory syncytial virus neutralization by motavizumab. Nat Struct Mol Biol 17, 248-250.

McLellan, J. S., Chen, M., Leung, S., Graepel, K. W., Du, X., Yang, Y., Zhou, T., Baxa, U., Yasuda, E., Beaumont, T., et al. (2013). Structure of RSV fusion glycoprotein trimer bound to a prefusion-specific neutralizing antibody. Science 340, 1113-1117.

McLellan, J. S., Yang, Y., Graham, B. S., and Kwong, P. D. (2011). Structure of respiratory syncytial virus fusion glycoprotein in the postfusion conformation reveals preservation of neutralizing epitopes. J Virol 85, 7788-7796.

Morin, A., Eisenbraun, B., Key, J., Sanschagrin, P. C., Timony, M. A., Ottaviano, M., and Sliz, P. (2013). Collaboration gets the most out of software. Elife 2, e01465.

Mousa, J. J., Kose, N., Matta, P., Gilchuk, P., and Crowe, J. E., Jr. (2017). A novel pre-fusion conformation-specific neutralizing epitope on the respiratory syncytial virus fusion protein. Nat Microbiol 2, 16271.

Murphy, B. R., Alling, D. W., Snyder, M. H., Walsh, E. E., Prince, G. A., Chanock, R. M., Hemming, V. G., Rodriguez, W. J., Kim, H. W., Graham, B. S., et al. (1986). Effect of age and preexisting antibody on serum antibody response of infants and children to the F and G glycoproteins during respiratory syncytial virus infection. J Clin Microbiol 24, 894-898.

Murphy, B. R., and Walsh, E. E. (1988). Formalin-inactivated respiratory syncytial virus vaccine induces antibodies to the fusion glycoprotein that are deficient in fusion-inhibiting activity. J Clin Microbiol 26, 1595-1597.

Ngwuta, J. O., Chen, M., Modjarrad, K., Joyce, M. G., Kanekiyo, M., Kumar, A., Yassine, H. M., Moin, S. M., Killikelly, A. M., Chuang, G. Y., et al. (2015). Prefusion F-specific antibodies determine the magnitude of RSV neutralizing activity in human sera. Sci Transl Med 7, 309ra162.

Panda, S., and Ding, J. L. (2015). Natural antibodies bridge innate and adaptive immunity. J Immunol 194, 13-20.

PATH (2017). RSV Vaccine and mAb Snapshot.

Polack, F. P., Teng, M. N., Collins, P. L., Prince, G. A., Exner, M., Regele, H., Lirman, D. D., Rabold, R., Hoffman, S. J., Karp, C. L., et al. (2002). A role for immune complexes in enhanced respiratory syncytial virus disease. J Exp Med 196, 859-865.

Potterton, E., Briggs, P., Turkenburg, M., and Dodson, E. (2003). A graphical user interface to the CCP4 program suite. Acta Crystallogr D Biol Crystallogr 59, 1131-1137.

Rechavi, E., Lev, A., Lee, Y. N., Simon, A. J., Yinon, Y., Lipitz, S., Amariglio, N., Weisz, B., Notarangelo, L. D., and Somech, R. (2015). Timely and spatially regulated maturation of B and T cell repertoire during human fetal development. Sci Transl Med 7, 276ra225.

Reed, J. H., Jackson, J., Christ, D., and Goodnow, C. C. (2016). Clonal redemption of autoantibodies by somatic hypermutation away from self-reactivity during human immunization. J Exp Med 213, 1255-1265.

Reichert, J. M. (2016). Antibodies to watch in 2016. MAbs 8, 197-204.

Ridings, J., Dinan, L., Williams, R., Roberton, D., and Zola, H. (1998). Somatic mutation of immunoglobulin V(H)6 genes in human infants. Clin Exp Immunol 114, 33-39.

Rossey, I., Gilman, M. S., Kabeche, S. C., Sedeyn, K., Wrapp, D., Kanekiyo, M., Chen, M., Mas, V., Spitaels, J., Melero, J. A., et al. (2017). Potent single-domain antibodies that arrest respiratory syncytial virus fusion protein in its prefusion state. Nat Commun 8, 14158.

Sande, C. J., Cane, P. A., and Nokes, D. J. (2014). The association between age and the development of respiratory syncytial virus neutralising antibody responses following natural infection in infants. Vaccine 32, 4726-4729.

Saravia, J., You, D., Shrestha, B., Jaligama, S., Siefker, D., Lee, G. I., Harding, J. N., Jones, T. L., Rovnaghi, C., Bagga, B., et al. (2015). Respiratory Syncytial Virus Disease Is Mediated by Age-Variable IL-33. PLoS Pathog 11, e1005217.

Sastre, P., Melero, J. A., Garcia-Barreno, B., and Palomo, C. (2005). Comparison of affinity chromatography and adsorption to vaccinia virus recombinant infected cells for depletion of antibodies directed against respiratory syncytial virus glycoproteins present in a human immunoglobulin preparation. J Med Virol 76, 248-255.

Sather, D. N., Armann, J., Ching, L. K., Mavrantoni, A., Sellhorn, G., Caldwell, Z., Yu, X., Wood, B., Self, S., Kalams, S., et al. (2009). Factors associated with the development of cross-reactive neutralizing antibodies during human immunodeficiency virus type 1 infection. J Virol 83, 757-769.

Shi, T., McAllister, D. A., O'Brien, K. L., Simoes, E. A. F., Madhi, S. A., Gessner, B. D., Polack, F. P., Balsells, E., Acacio, S., Aguayo, C., et al. (2017). Global, regional, and national disease burden estimates of acute lower respiratory infections due to respiratory syncytial virus in young children in 2015: a systematic review and modelling study. Lancet.

Shinoff, J. J., O'Brien, K. L., Thumar, B., Shaw, J. B., Reid, R., Hua, W., Santosham, M., and Karron, R. A. (2008). Young infants can develop protective levels of neutralizing antibody after infection with respiratory syncytial virus. J Infect Dis 198, 1007-1015.

Siegrist, C. A., and Aspinall, R. (2009). B-cell responses to vaccination at the extremes of age. Nat Rev Immunol 9, 185-194.

Simek, M. D., Rida, W., Priddy, F. H., Pung, P., Carrow, E., Laufer, D. S., Lehrman, J. K., Boaz, M., Tarragona-Fiol, T., Miiro, G., et al. (2009). Human immunodeficiency virus type 1 elite neutralizers: individuals with broad and potent neutralizing activity identified by using a high-throughput neutralization assay together with an analytical selection algorithm. J Virol 83, 7337-7348.

Sok, D., Briney, B., Jardine, J. G., Kulp, D. W., Menis, S., Pauthner, M., Wood, A., Lee, E. C., Le, K. M., Jones, M., et al. (2016). Priming HIV-1 broadly neutralizing antibody precursors in human Ig loci transgenic mice. Science 353, 1557-1560.

Sui, J., Hwang, W. C., Perez, S., Wei, G., Aird, D., Chen, L. M., Santelli, E., Stec, B., Cadwell, G., Ali, M., et al. (2009). Structural and functional bases for broad-spectrum neutralization of avian and human influenza A viruses. Nat Struct Mol Biol 16, 265-273.

Swanson, K. A., Settembre, E. C., Shaw, C. A., Dey, A. K., Rappuoli, R., Mandl, C. W., Dormitzer, P. R., and Carfi, A. (2011). Structural basis for immunization with post-fusion respiratory syncytial virus fusion F glycoprotein (RSV F) to elicit high neutralizing antibody titers. Proc Natl Acad Sci USA 108, 9619-9624.

Swers, J. S., Kellogg, B. A., and Wittrup, K. D. (2004). Shuffled antibody libraries created by in vivo homologous recombination and yeast surface display. Nucleic Acids Res 32, e36.

Thomson, C. A., Bryson, S., McLean, G. R., Creagh, A. L., Pai, E. F., and Schrader, J. W. (2008). Germline V-genes sculpt the binding site of a family of antibodies neutralizing human cytomegalovirus. EMBO J 27, 2592-2602.

Throsby, M., van den Brink, E., Jongeneelen, M., Poon, L. L., Alard, P., Cornelissen, L., Bakker, A., Cox, F., van Deventer, E., Guan, Y., et al. (2008). Heterosubtypic neutralizing monoclonal antibodies cross-protective against H5N1 and H1N1 recovered from human IgM+ memory B cells. PLoS One 3, e3942.

Tiller, T., Meffre, E., Yurasov, S., Tsuiji, M., Nussenzweig, M. C., and Wardemann, H. (2008). Efficient generation of monoclonal antibodies from single human B cells by single cell RT-PCR and expression vector cloning. J Immunol Methods 329, 112-124.

Trang, N. V., Braeckman, T., Lernout, T., Hau, V. T., Anh le, T. K., Luan le, T., Van Damme, P., and Anh, D. D. (2014). Prevalence of rotavirus antibodies in breast milk and inhibitory effects to rotavirus vaccines. Hum Vaccin Immunother 10, 3681-3687.

Troisi, C. L., Hollinger, F. B., Krause, D. S., and Pickering, L. K. (1997). Immunization of seronegative infants with hepatitis A vaccine (HAVRIX; SKB): a comparative study of two dosing schedules. Vaccine 15, 1613-1617.

Wang, J., He, Y., Jin, D., Liu, J., Zheng, J., Yuan, N., Bai, Y., Yan, T., Yang, Y., Liu, Y., et al. (2017). No response to hepatitis B vaccine in infants born to HBsAg(+) mothers is associated to the transplacental transfer of HBsAg. Infect Dis (Lond), 1-8.

Wen, X., Mousa, J. J., Bates, J. T., Lamb, R. A., Crowe, J. E., Jr., and Jardetzky, T. S. (2017). Structural basis for antibody cross-neutralization of respiratory syncytial virus and human metapneumovirus. Nat Microbiol 2, 16272.

Williams, J. V., Weitkamp, J. H., Blum, D. L., LaFleur, B. J., and Crowe, J. E., Jr. (2009). The human neonatal B cell response to respiratory syncytial virus uses a biased antibody variable gene repertoire that lacks somatic mutations. Mol Immunol 47, 407-414.

Wu, S. J., Schmidt, A., Beil, E. J., Day, N.D., Branigan, P. J., Liu, C., Gutshall, L. L., Palomo, C., Furze, J., Taylor, G., et al. (2007). Characterization of the epitope for anti-human respiratory syncytial virus F protein monoclonal antibody 101F using synthetic peptides and genetic approaches. J Gen Virol 88, 2719-2723.

Xu, Y., Roach, W., Sun, T., Jain, T., Prinz, B., Yu, T. Y., Torrey, J., Thomas, J., Bobrowicz, P., Vasquez, M., et al. (2013). Addressing polyspecificity of antibodies selected from an in vitro yeast presentation system: a FACS-based, high-throughput selection and analytical tool. Protein Eng Des Sel 26, 663-670.

Yacoob, C., Pancera, M., Vigdorovich, V., Oliver, B. G., Glenn, J. A., Feng, J., Sather, D. N., McGuire, A. T., and Stamatatos, L. (2016). Differences in Allelic Frequency and CDRH3 Region Limit the Engagement of HIV Env Immunogens by Putative VRC01 Neutralizing Antibody Precursors. Cell Rep 17, 1560-1570.

Yeung, Y. A., Foletti, D., Deng, X., Abdiche, Y., Strop, P., Glanville, J., Pitts, S., Lindquist, K., Sundar, P. D., Sirota, M., et al. (2016). Germline-encoded neutralization of a *Staphylococcus aureus* virulence factor by the human antibody repertoire. Nat Commun 7, 13376.

Zhang, X., Zhivaki, D., and Lo-Man, R. (2017). Unique aspects of the perinatal immune system. Nat Rev Immunol.

Zhu, Q., McLellan, J. S., Kallewaard, N. L., Ulbrandt, N.D., Palaszynski, S., Zhang, J., Moldt, B., Khan, A., Svabek, C., McAuliffe, J. M., et al. (2017). A highly potent extended half-life antibody as a potential RSV vaccine surrogate for all infants. Sci Transl Med 9

Example 2. Isolation and Characterization of Anti-RSV F-Specific Human Infant Antibodies from Adenoid and PBMCs Applicant has comprehensively profiled the human infant antibody response to RSV F by isolating and characterizing over 800 RSV F-specific monoclonal antibodies from paired nasopharyngeal adenoid (adenoid) and peripheral blood samples (PBMCs) of RSV-infected infants, and used these antibodies to characterize the infant antibody response as well as develop a framework for the rational design of age-specific RSV vaccines. RSV F-specific memory B cell responses were detected in the adenoids of all 6 children, and the adenoid-derived antibodies showed overall higher binding affinities and neutralization potencies compared to antibodies isolated from paired peripheral blood samples. Approximately 25% of the neutralizing antibodies isolated from adenoid tissue were derived from a unique population of IgM$^+$ and/or IgD$^+$ memory B cells that contained a high load of somatic mutations but lacked expression of classical memory B cell markers. The collective results provide insight into the mucosal B cell response to RSV and have implications for the development of vaccines that stimulate potent local responses.

Isolation of RSV F-Specific B Cells from Paired Adenoid and Peripheral Blood Samples To analyze and compare the mucosal and systemic B cell response to natural RSV infection, paired adenoid tissue and peripheral blood samples were obtained from 6 young children between the ages of 2 and 4 years old who were undergoing tonsillectomy (Supplementary Table 1). Adenoids were used as a representative source of respiratory mucosal lymphocytes because this lymphoid tissue has been previously shown to be an important induction site for B cells that migrate to the respiratory tract and associated glands (Czerkinsky et al 1994, McGhee 2000, Brandtzaeg P1. 2011). The adenoid's location at the site of entry into the upper respiratory tract also suggests a role in anti-RSV immunity. Although none of the children had a documented history of RSV infection, previous studies have shown that essentially all children have been infected by RSV at least once by the age of 2. Consistent with the notion of prior RSV exposure, serum samples obtained from all six children displayed neutralizing activity against RSV-A2 (Supplementary Table 1).

SUPPLEMENTARY TABLE 1

Neutralizing activity against RSV-A2

| Subject | Gender | Age (yrs) | Plasma | 50% RSV neutralization titer | |
|---|---|---|---|---|---|
| | | | | Adenoid filter | Adenoid supernatant |
| 2635 | M | 3.60 | 545 | 9 | 9 |
| 2637 | F | 3.13 | 639 | <4 | 13 |
| 2665 | M | 2.82 | 506 | <4 | <4 |
| 2666 | F | 3.05 | 1702 | 13 | 177 |
| 2849 | M | 2.79 | 5133 | 4 | 55 |
| 2850 | M | 2.97 | 720 | 6 | 5 |

Figure 13A:
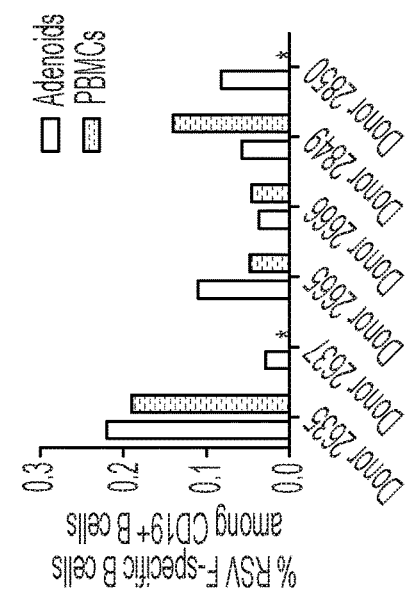
Figure 13A:
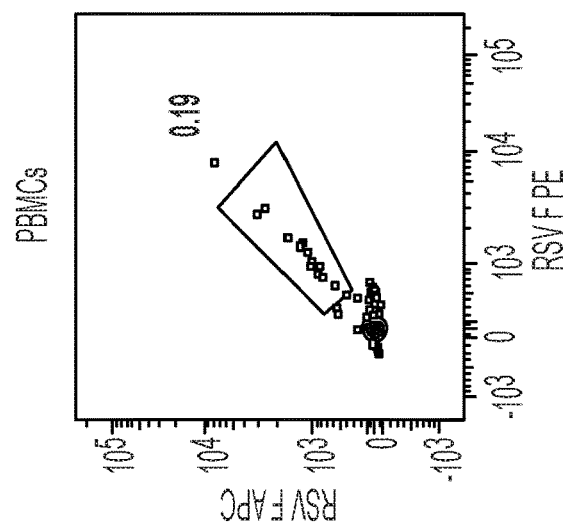
Figure 13A:
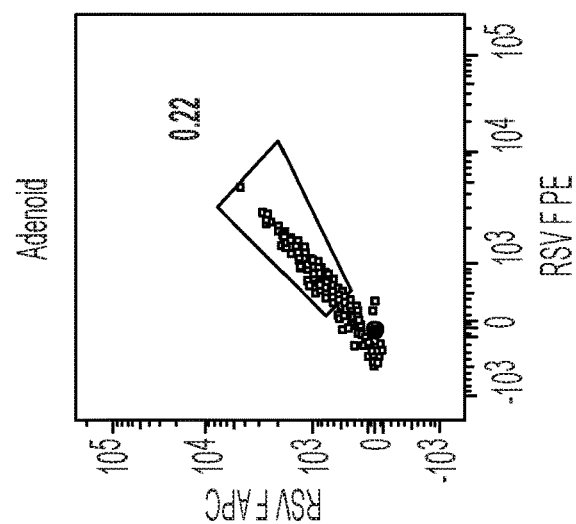
Figure 14A:
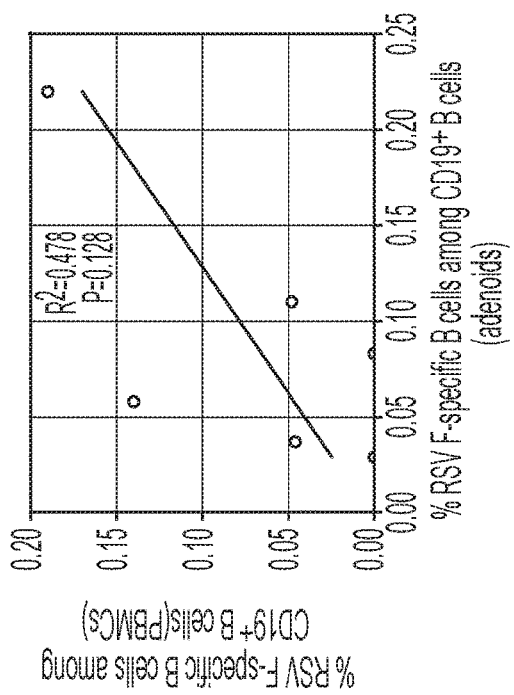
FIGS. 14A-B show the lack of a clear correlation between the frequency of RSV F-reactive B cells in either compartment and serum neutralization titer.
Figure 14B:
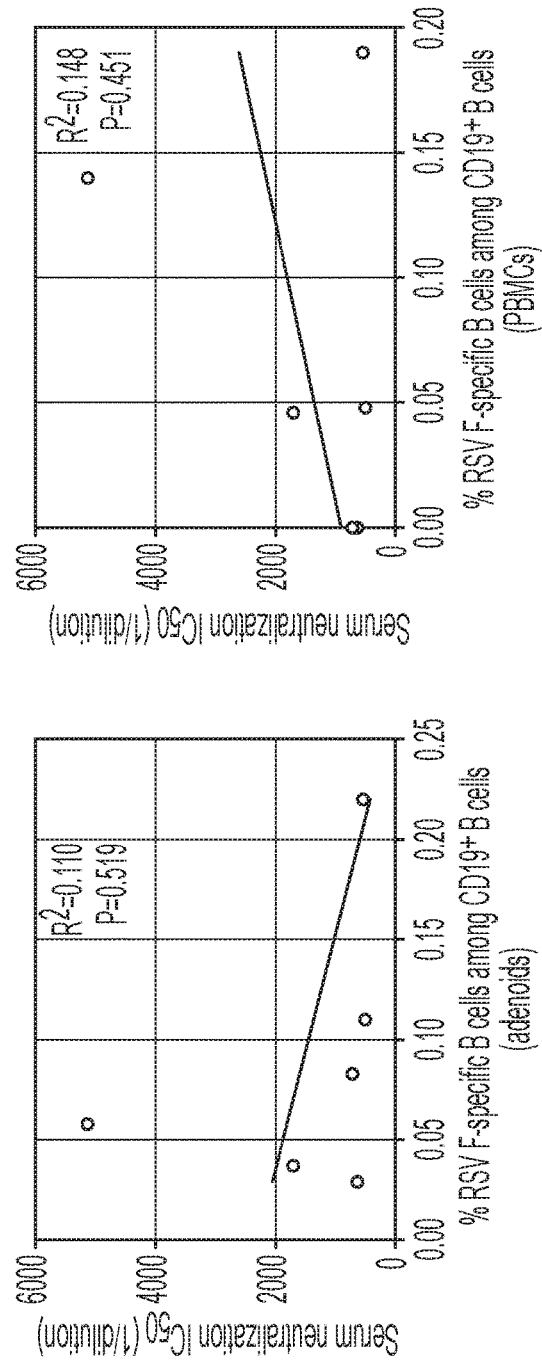

To assess the magnitude of the RSV F-specific B cell response in both anatomical compartments, the adenoid and PBMC samples were stained with a panel of B cell markers (CD19, CD20, IgG, IgA, CD27, and FCRL4) and fluorescently-labeled tetramers of RSV preF and postF and analyzed by flow cytometry (FIG. 13A). RSV F-reactive B cells were detected in the adenoid samples from all 6 donors but in only 4 of the 6 corresponding PBMC samples (FIG. 13B). The frequency of RSV F-specific B cells in the adenoid and PBMC samples ranged from 0.03-0.22% and 0-0.19%, respectively. There was no clear correlation between 1) the frequency of RSV F-reactive B cells in peripheral blood and adenoid tissue, and 2) the frequency of RSV F-reactive B cells in either compartment (FIG. 14A) and serum neutralization titer (FIG. 14B). The latter result is consistent with previous studies showing a lack of correlation between the frequencies of antigen-specific memory B cells and serum titers of antigen specific IgG.

Next, between 100-300 RSV F-reactive B cells from both the adenoid and PBMC samples from each of the four donors that had detectable RSV F-specific B cell responses in both compartments were single-cell sorted. Although all RSV F-reactive B cells were sorted, index sorting allowed for the determination of the B cell surface markers expressed on each sorted cell. This analysis showed that the RSV F-specific B cell subset distribution varied considerably between the two compartments and among the four donors (FIG. 13B). For example, in some donors, there was a higher proportion of RSV F-specific IgG+ memory B cells in peripheral blood compared to adenoid tissue (e.g. donor 2635 and donor 2849), whereas the converse was observed in other donors (e.g. donor 2665). Notably, in all four donors, there was little to no enrichment for RSV F-specific IgA+ B cells in the adenoid samples relative to the corresponding PBMC samples, and in one donor (donor 2665) there was a substantially higher proportion of RSV F-specific IgA+ B cells in peripheral blood compared to adenoid tissue (FIG. 13B). Furthermore, in all donors, a considerable proportion (21-52%) of RSV F-specific B cells in both compartments were not class-switched and lacked the expression of the classical memory B cell marker CD27. Since previous studies have shown that the inhibitory receptor FcRL4 is expressed on a proportion of tissue-resident memory B cells (Ehrhardt et al, J Exp Med 2005), it was analyzed whether this marker was preferentially expressed on certain subsets of adenoid-derived B cells. A proportion of B cell clones within most of the subsets in both compartments expressed FcRL4, with the exception of the IgG− IgA−CD27− and adenoid-resident IgG+ CD27− subsets, and the large majority of FcRL4+ B cells in both compartments were of the IgA isotype (FIG. 13C). Therefore, it was concluded that natural RSV infection induces memory B cell responses in the adenoids of young children, and the contribution of different memory B cell populations to the RSV-specific response varies among donors and between the mucosal and systemic compartments.

Figure 15A:
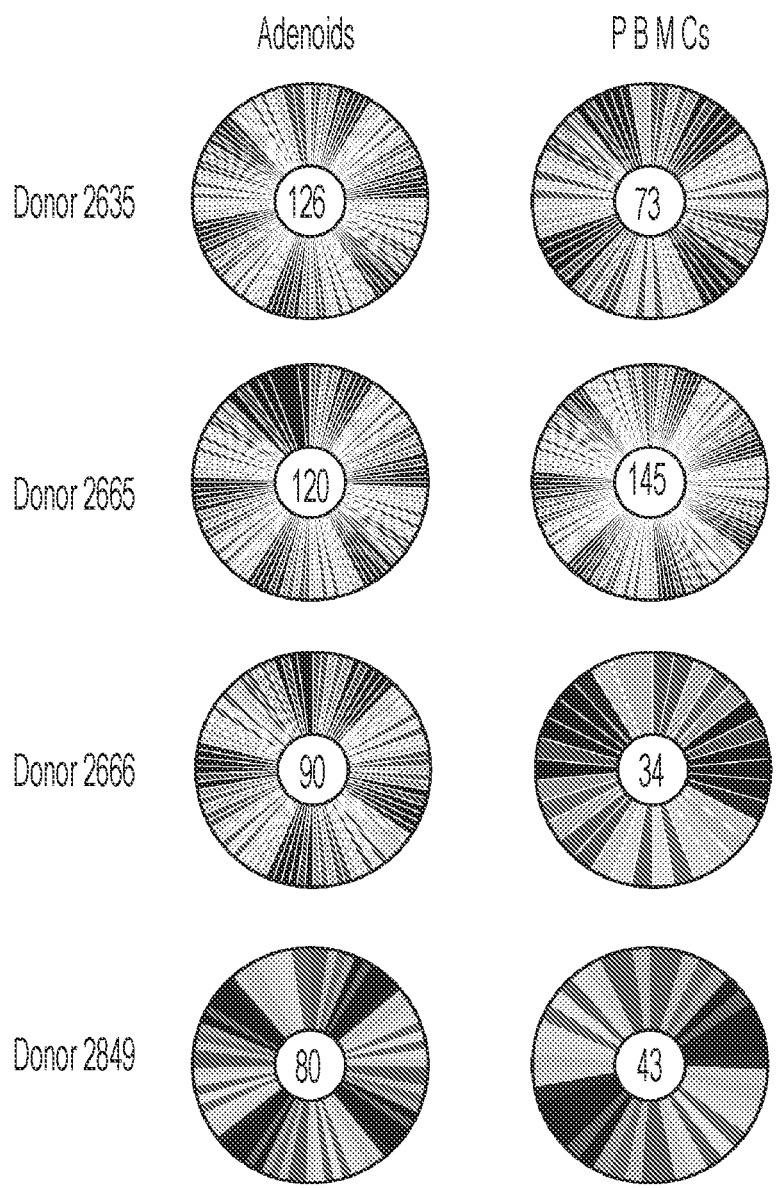
FIGS. 15A-C characterize the RSV-specific mucosal B cell response.

An Atypical Population of RSV-Specific Memory B Cells is Enriched in Adenoid Tissue To further characterize the RSV-specific mucosal B cell response, the antibody variable heavy (VH) and variable light (VL) chain sequences from the sorted B cells were amplified by single cell-PCR. Over 800 cognate VH-VL pairs were cloned into an IgG1 expression vector for sequencing and IgG production. Sequence analysis revealed that the RSV F-specific antibody repertoires were highly diverse in both compartments in all donors, each containing few to no expanded clonal lineages (FIG. 15A). Although deeper sequencing would be required to accurately determine the degree of overlap between the RSV F-specific clones in each compartment, one clonal lineage was identified in both the adenoid- and PBMC-derived antibody panels isolated from donor 2635 (supplementary table 2), suggesting that at least a proportion of RSV F-specific B cells recirculate between the mucosal and systemic compartments.

SUPPLEMENTARY TABLE 2

Clonal lineage from donor 2635

| VL CDR1 | VL FR2 | VL CDR2 |
|---|---|---|
| RSSQSLLHSNGFNYLD (SEQ ID NO: 1895) | WYLQKPGQSPQLLIY (SEQ ID NO: 1896) | LGSNRAS (SEQ ID NO: 1897) |
| RSSQSLLHSNGFNYLD (SEQ ID NO: 1895) | WYLQKPGQSPQLLIY (SEQ ID NO: 1896) | LGSNRAS (SEQ ID NO: 1895) |

| VL FR3 | VL CDR3 | VL FR4 |
|---|---|---|
| GVPDRFSGSGSGTDFTLKISRVEAEDVGVYYC (SEQ ID NO: 1898) | MQALQTLT (SEQ ID NO: 1899) | FGPGTKVEIK (SEQ ID NO: 1900) |

SUPPLEMENTARY TABLE 2-continued

Clonal lineage from donor 2635

GVPDRFSGSGSGTDFTLKISRVEAEDVGVYYC MQALQTLT FGGGTKVEIK
(SEQ ID NO: 1898) (SEQ ID NO: 1899) (SEQ ID NO: 1901)

Figure 15B:
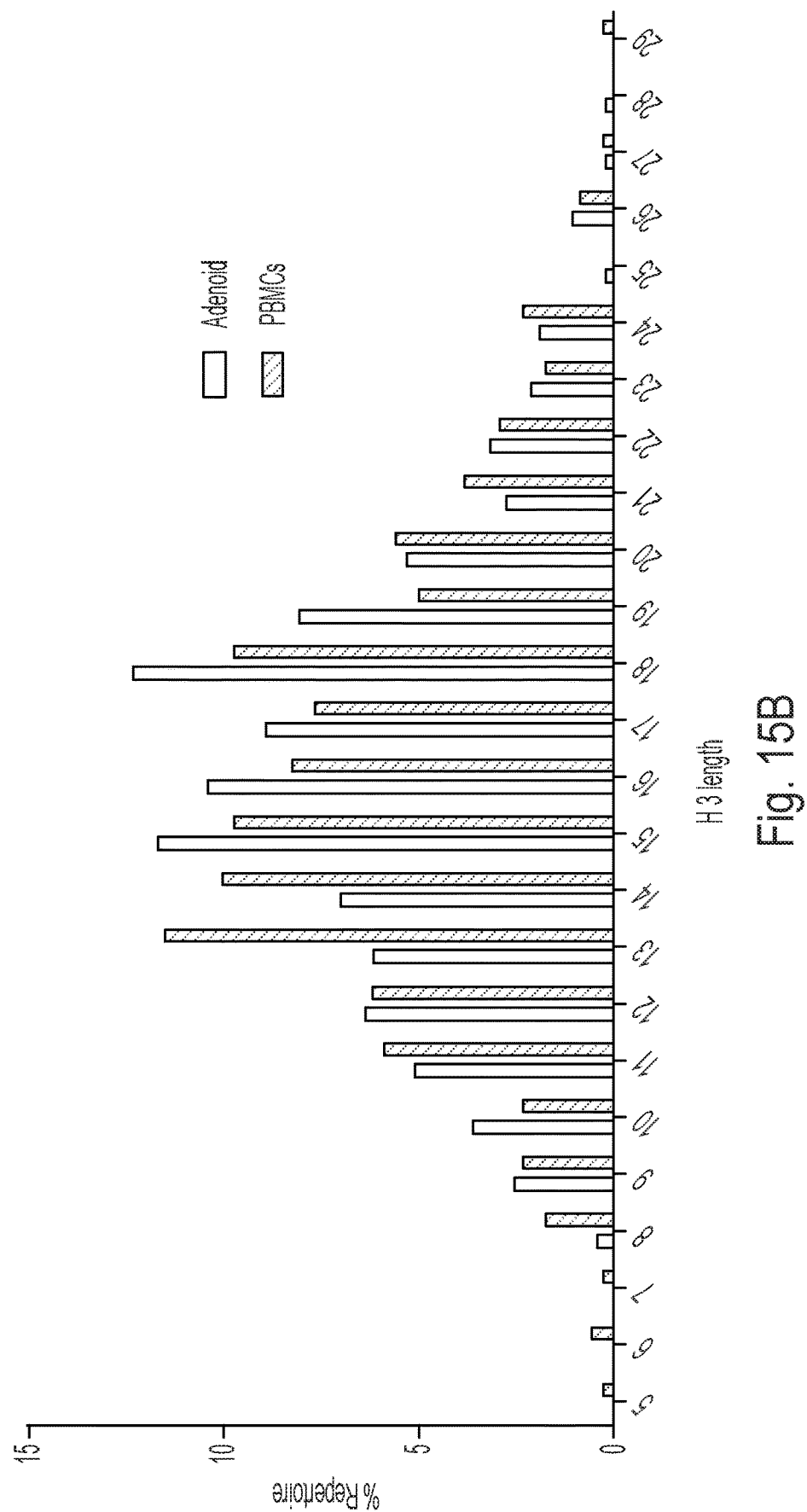
Figure 15C:
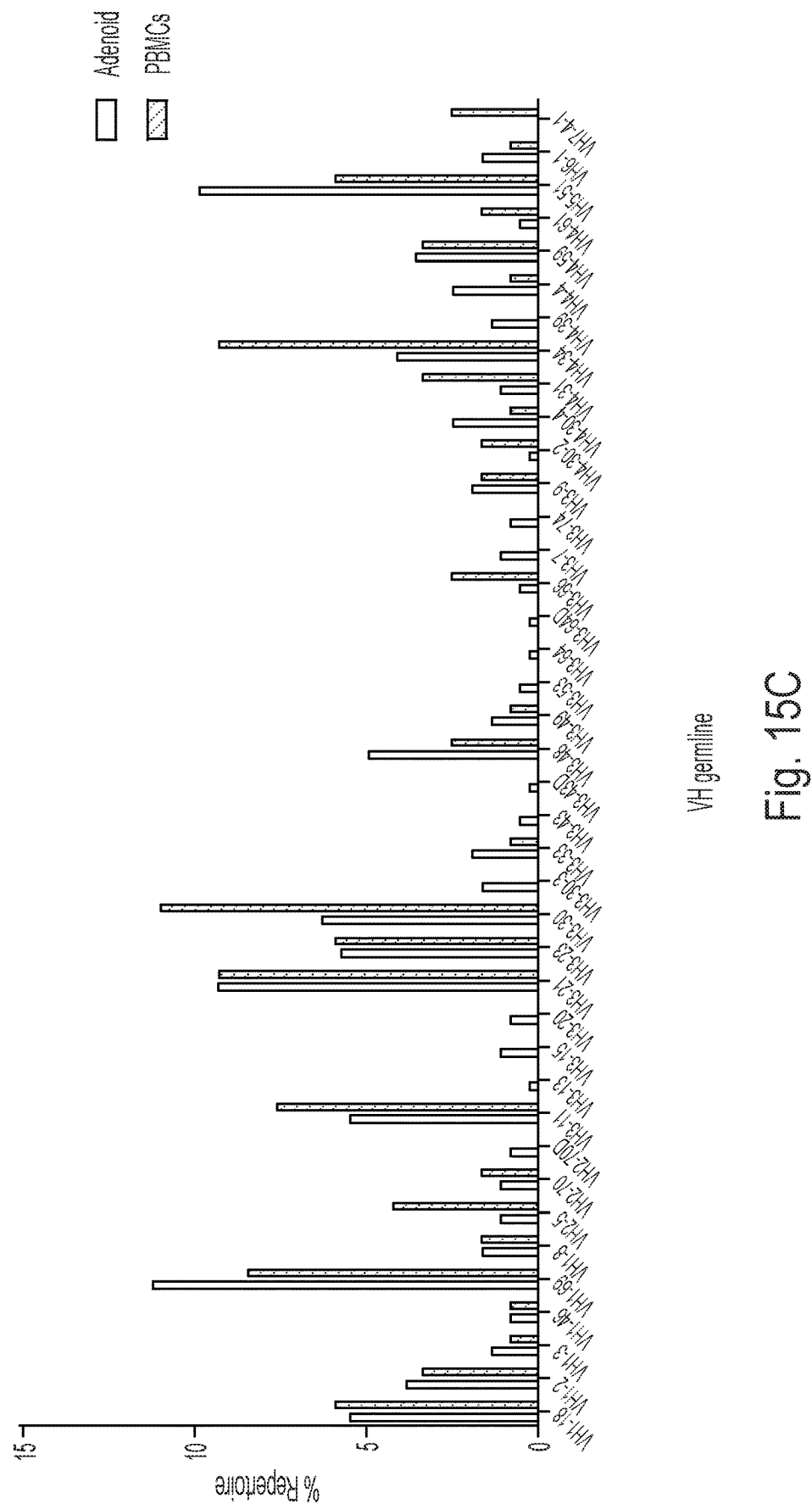

Next, the CDRH3 length distribution, VH germline gene usage, and load of somatic mutations in the antibodies isolated from the two compartments were analyzed (FIG. 15B). The median CDRH3 lengths of the antibodies isolated from PBMCs and adenoids were 15 and 16 amino acids, respectively, which is consistent with previously reported median CDRH3 lengths for anti-viral antibodies (Gilman et al., Sci Immunol. 2016; Bornholdt et al., Science 2016; Collis and Martin, J M B 2003). Although the VH germline gene usage was also comparable between the two compartments, there was an enrichment for VH5-51 and VH1-69 in the adenoid-derived antibodies and an enrichment for VH4-34 and VH3-30 in the PBMC-derived antibodies across all four donor repertoires (FIG. 15C). The level of somatic mutation in the antibodies varied among the 4 donors, with the median number of VH nucleotide substitutions ranging from 8-11 in the adenoid-derived antibodies and 7-9 in the PBMC-derived antibodies (FIG. 16A and FIG. 17A-D). For 3 out of 4 donors, the load of somatic mutations trended higher in the adenoid-derived antibodies relative to the PBMC-derived antibodies, but this difference only reached statistical significance in donor 2665.

Figure 16A:
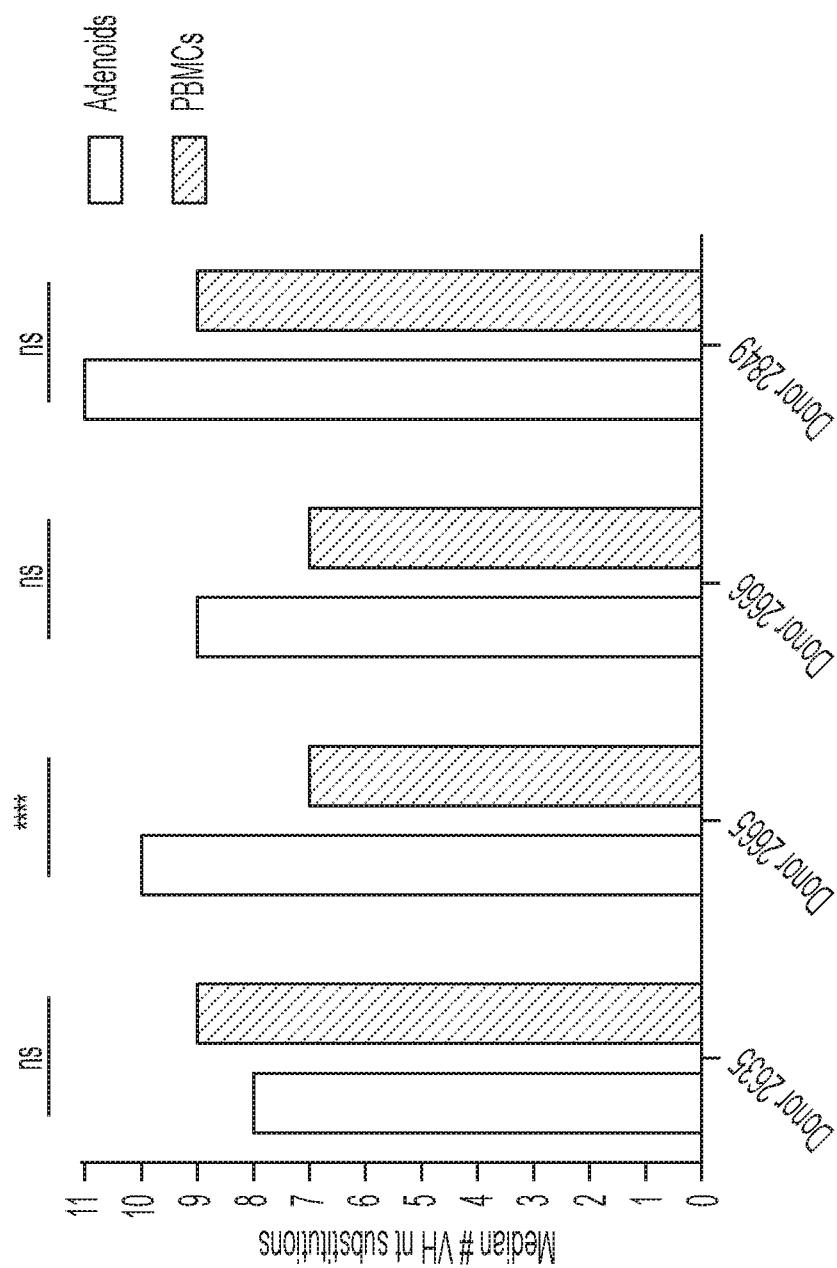
FIGS. 16A-E show the level of somatic mutation in the antibodies was varied among the 4 donors.
Figure 16B:
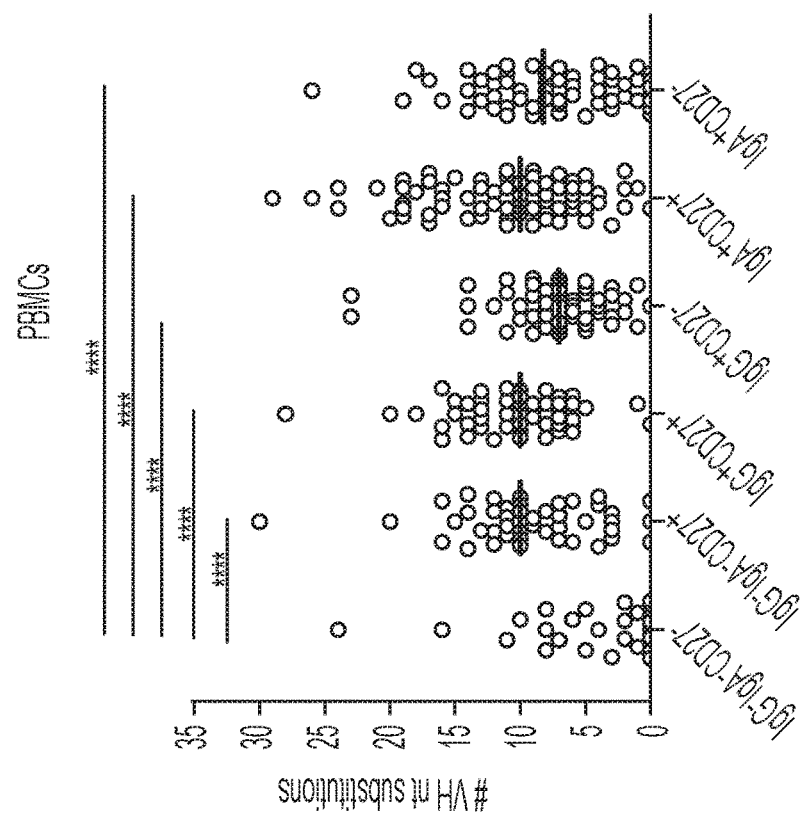
Figure 16B:
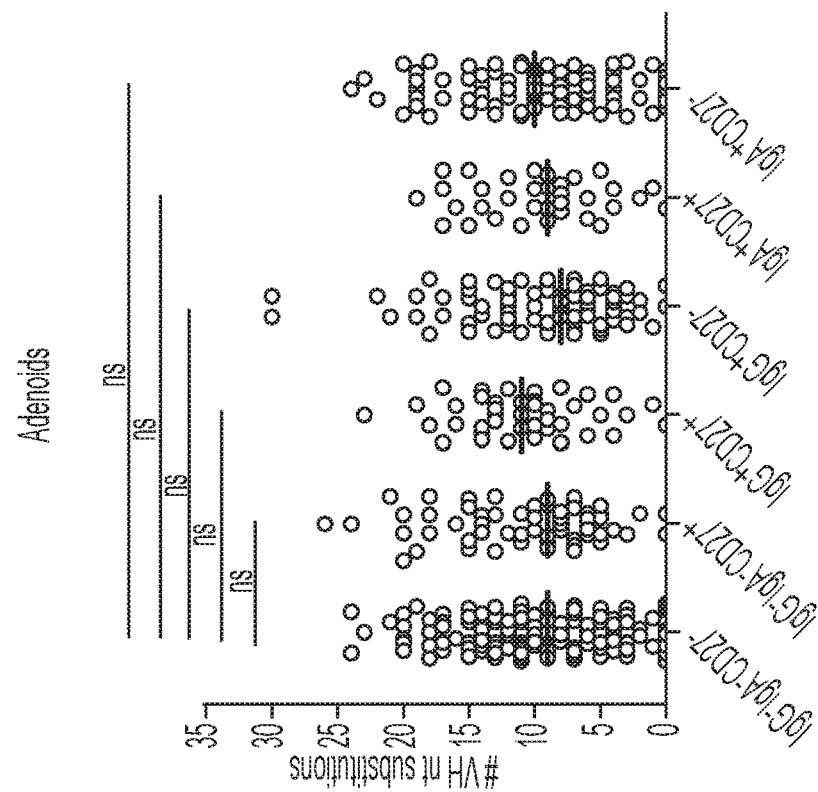
Figure 16D:
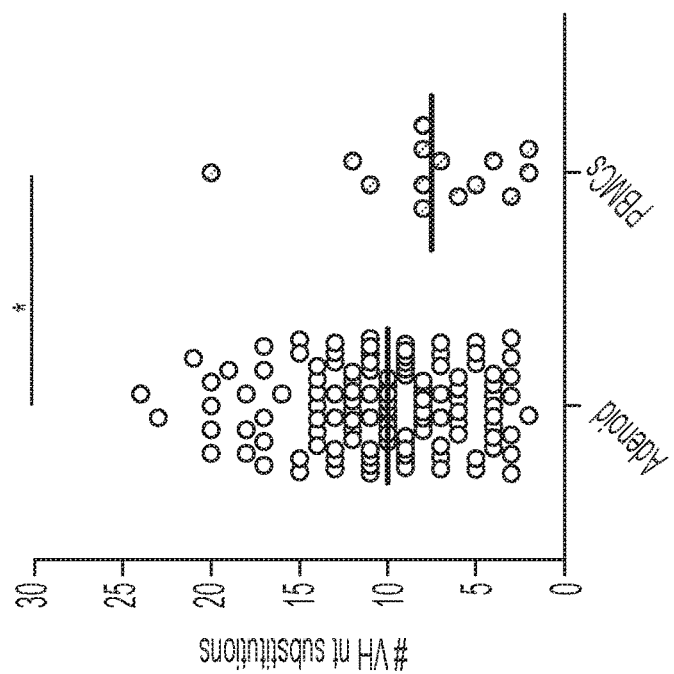
Figure 16C:
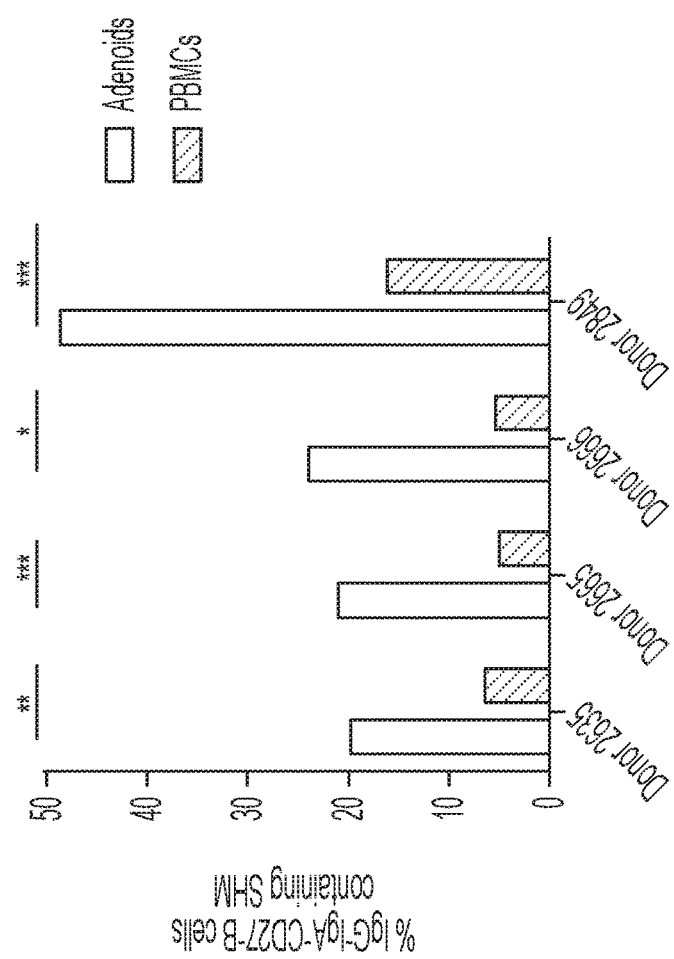
Figure 16E:
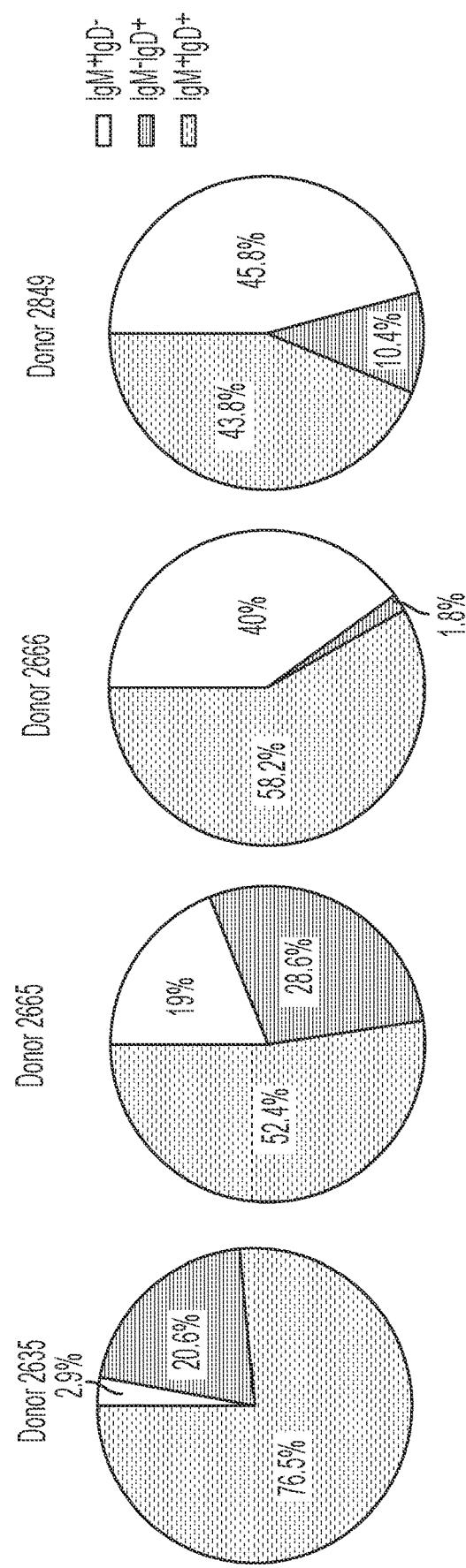
Figure 17A:
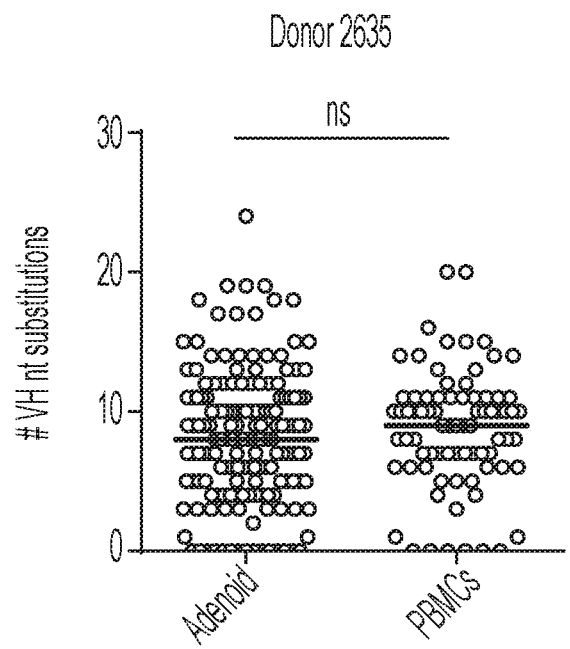
FIGS. 17A-D show the number of VH nucleotide substitutions in the adenoid-derived antibodies and PBMC-derived antibodies for each donor.
Figure 17B:
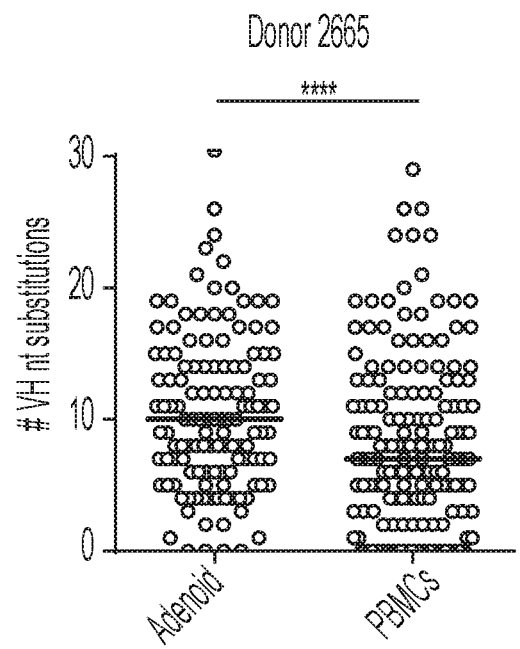
Figure 17C:
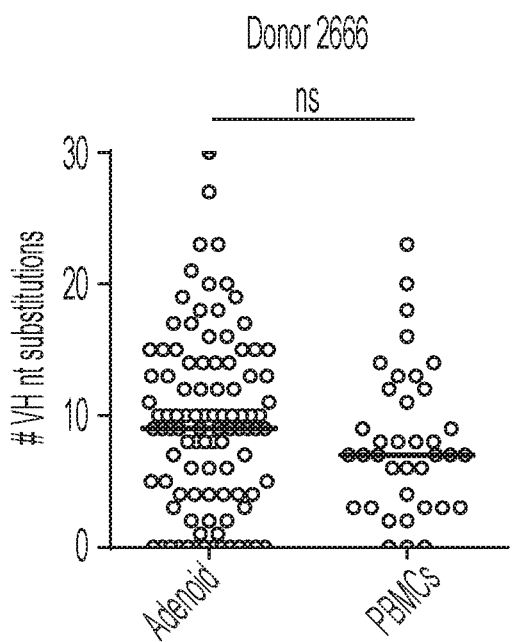
Figure 17D:
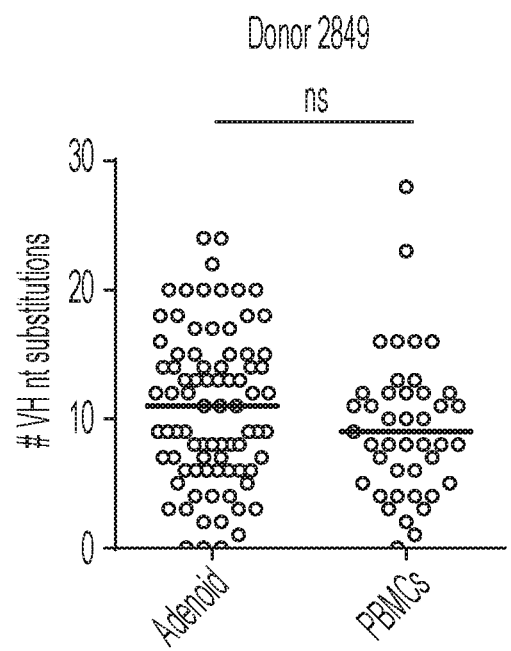

Analysis of the level of SHM within each individual B cell subset revealed that the antibodies derived from the IgG$^-$IgA$^-$CD27$^-$ adenoid B cells contained similar levels of SHM as classical IgG$^+$ CD27$^+$ and IgA$^+$ CD27$^+$ memory B cells, providing evidence that these B cells are germinal center-experienced (FIG. 16B). In contrast, the majority of antibodies derived from IgG$^-$ IgA$^-$CD27$^-$ peripheral blood B cells lacked SHM, indicating a naïve B cell origin. In all 4 donors, the percentage of RSV F-specific IgG$^-$IgA$^-$CD27$^-$ B cells containing SHM was significantly higher in adenoids compared to PBMCs (FIG. 16C). Furthermore, even the small subset of somatically mutated antibodies derived from IgG$^-$IgA$^-$CD27$^-$ peripheral blood B cells contained lower levels of SHM compared to antibodies derived from IgG$^-$ IgA$^-$CD27$^-$ adenoid B cells (FIG. 16D). To investigate the IgM and IgD expression profiles of the RSV F-specific IgG$^-$IgA$^-$CD27$^-$ adenoid B cells, the adenoid samples were restained with fluorescently labeled RSV F and a panel of secondary antibodies that included anti-human IgG, IgA, IgM, IgD, and CD27. This analysis revealed a high level of heterogeneity in IgM and IgD expression within this population of RSV F-specific B cells, with some of these B cells expressing only IgM or IgD and others co-expressing both markers (FIG. 16E). These B cells appear to belong to a unique population IgM and/or IgD memory B cells that contain somatic mutations but lack expression of previously described memory B cell markers.

Figure 18A:
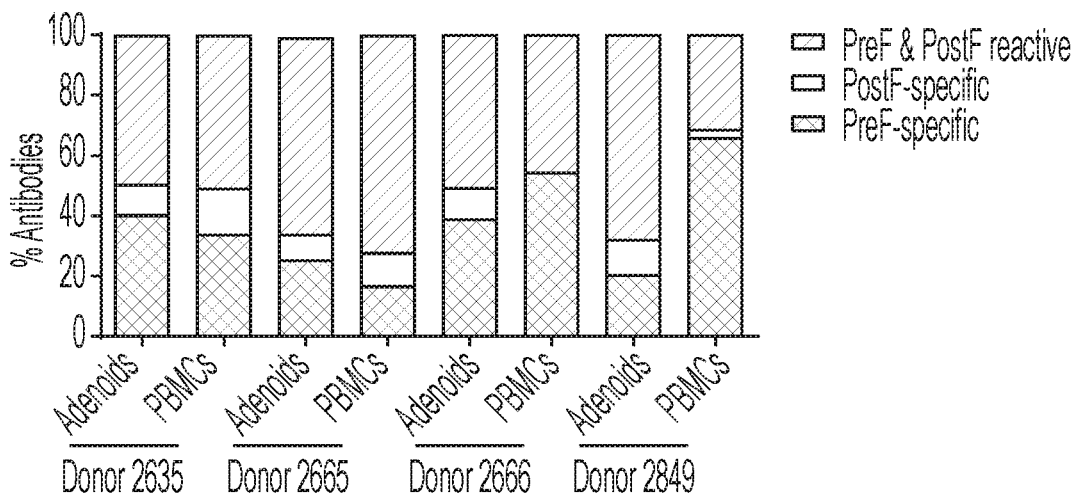
FIGS. 18A-B show the binding properties of the adenoid and PBMC-derived antibodies.

A Higher Proportion of Adenoid-Derived Antibodies Display High Affinity Binding and Potent Neutralizing Activity Compared to PBMC-Derived Antibodies The apparent (IgG) binding affinities of the antibodies for RSV preF and postF were then measured using biolayer interferometry. The percentage of antibodies that bound exclusively to either preF or postF varied across the 4 donors but was similar between the two compartments within individual donors, with the exception of donor 2849, in which preF-specific antibodies were present at higher frequency in PBMCs compared to adenoid tissue (FIG. 18A). As observed in previous studies, a larger proportion of antibodies bound exclusively to preF (16-65%) than to postF (0-15%), demonstrating that the unique surfaces on preF are likely more immunogenic than those on postF. Although finer epitope mapping is required to better resolve the differences in epitope distribution between the two compartments, the results suggest that the relative immunogenicity of the different antigenic surfaces on RSV F is probably more dependent on the donor repertoire and/or immune history than on the anatomical site of B cell activation (FIG. 18A).

Figure 18B:
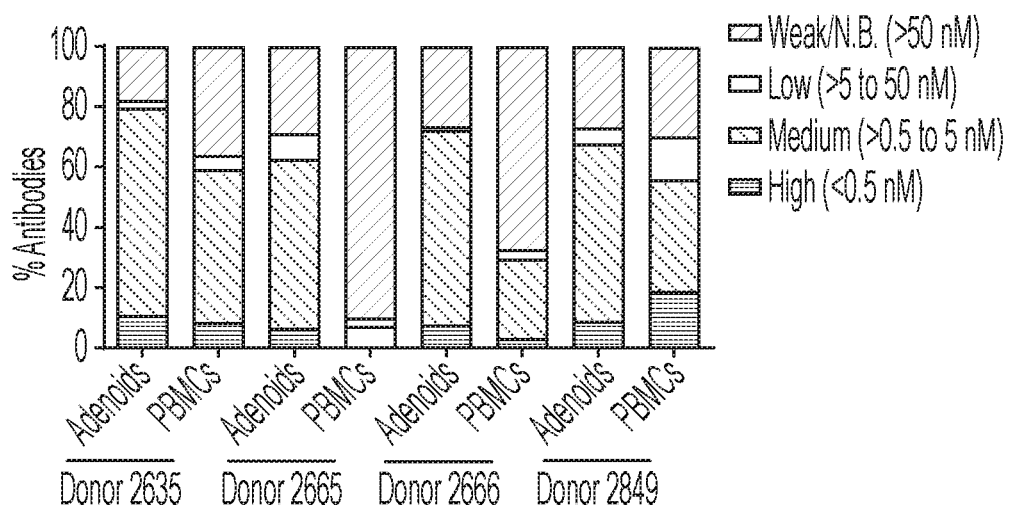

In 3 out of 4 donors, a higher proportion of RSV F-specific antibodies isolated from adenoids bound with medium to high affinity to preF (apparent $K_D$<5.0 nM) compared to antibodies derived from RSV F-reactive peripheral blood B cells (FIG. 18B). For example, 70% of the adenoid-derived antibodies cloned from donor 2666 displayed medium to high binding affinity to preF compared to only about 30% of the PBMC-derived antibodies. This result, combined with the observation that two additional donors had detectable RSV F-specific B cell responses in adenoid tissue but not in peripheral blood (FIG. 13B), suggests that the mucosal B cell response to RSV may be more robust than the corresponding systemic B cell response.

Figure 19A:
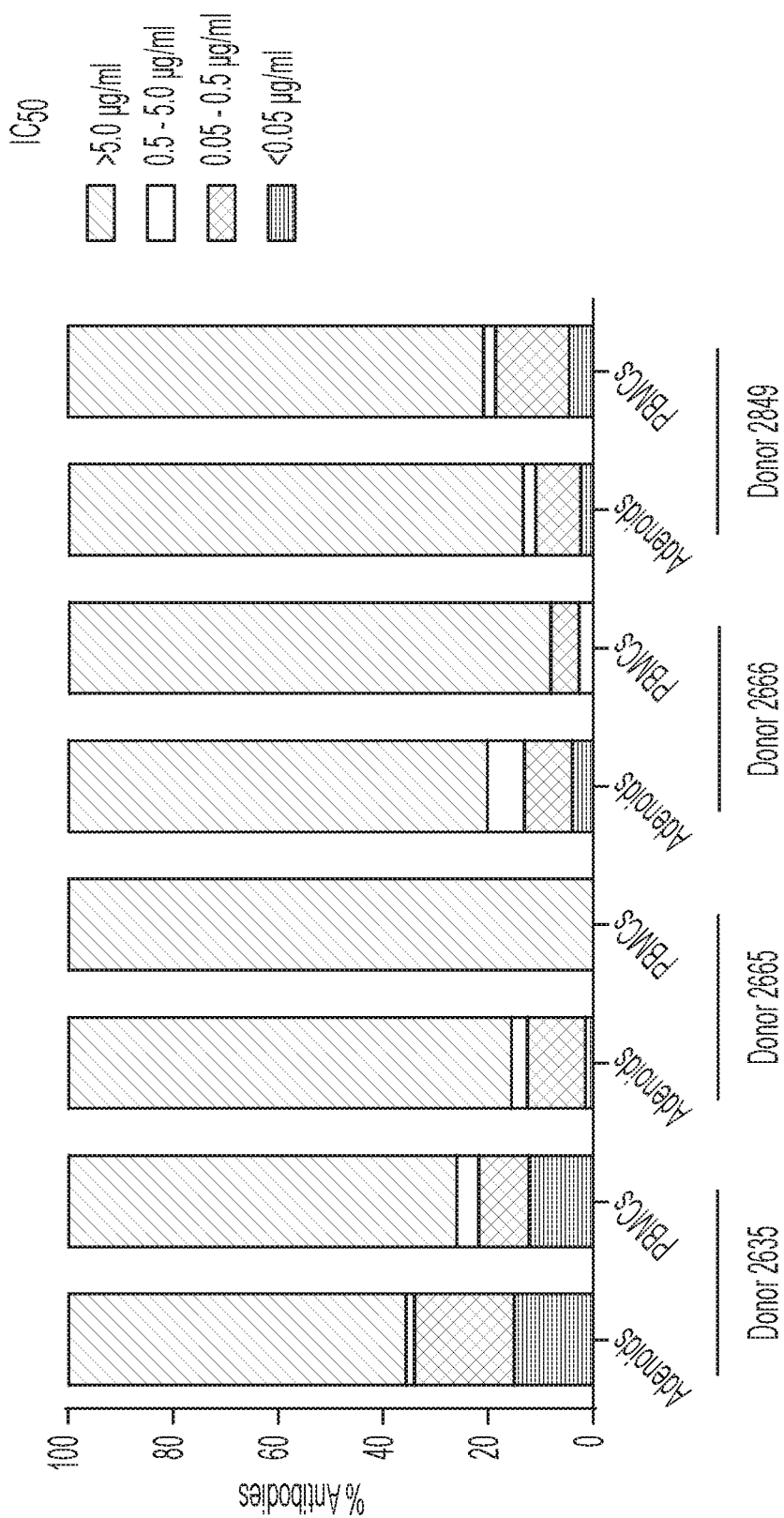
FIGS. 19A-D show the neutralizing activity of the adenoid and PBMC-derived antibodies against RSV-A2.

Next, the antibodies were tested for neutralizing activity against RSV-A2 using a previously described luciferase-based assay. 14% to 36% of the adenoid-derived antibodies and 0% to 26% of the PBMC-derived antibodies showed detectable neutralizing activity ($IC_{50}$<25 µg/mL) (FIG. 19A). In all donors, less than 20% of antibodies from both compartments showed highly potent neutralizing activity ($IC_{50}$<0.05 µg/mL), which is lower than that observed for three previously characterized healthy adult donors, in which 19-38% of isolated antibodies neutralized with high potency. The low fraction of highly potent neutralizing antibodies may be due to the young age of these donors, some of which have likely only experienced a single RSV infection. Consistent with this explanation, the antibody panel isolated from the oldest donor (donor 2635) contained the highest proportion of highly potent antibodies (FIG. 19A).

Figure 19B:
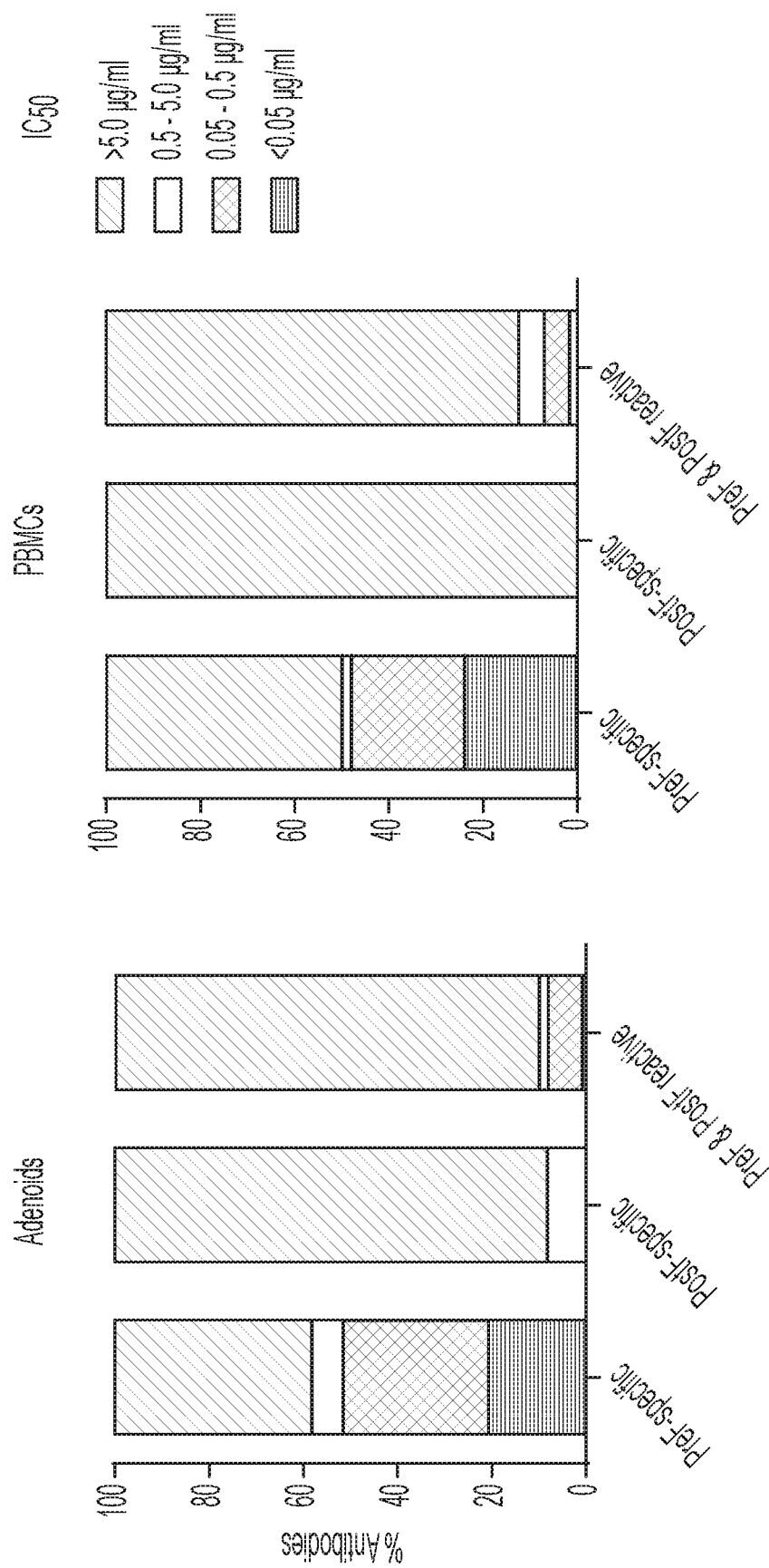

Consistent with the binding analysis, for 3 out of 4 donors, a larger proportion of adenoid-derived antibodies showed neutralizing activity compared to PBMC-derived antibodies (FIG. 19A). For example, for donor 2665, approximately 15% of adenoid-derived antibodies neutralized with an $IC_{50}$≤25 pg/mL whereas none of the PBMC-derived antibodies showed detectable activity at this concentration. Analysis of the relationship between preF- and postF binding activity and neutralization potency revealed that 50-60% of preF-specific antibodies isolated from both adenoids and PBMCs showed neutralizing activity compared to only 0-8% of postF-specific antibodies and 10-12% of conformation-independent antibodies (FIG. 19B). Importantly, greater than 90% of highly potent antibodies ($IC_{50}$<0.05 pg/mL) isolated from both compartments bound exclusively to preF. The antibody characteristics for antibodies derived from adenoid tissue and PBMCs are shown in Tables 6 and 7, respectively.

Figure 19C:
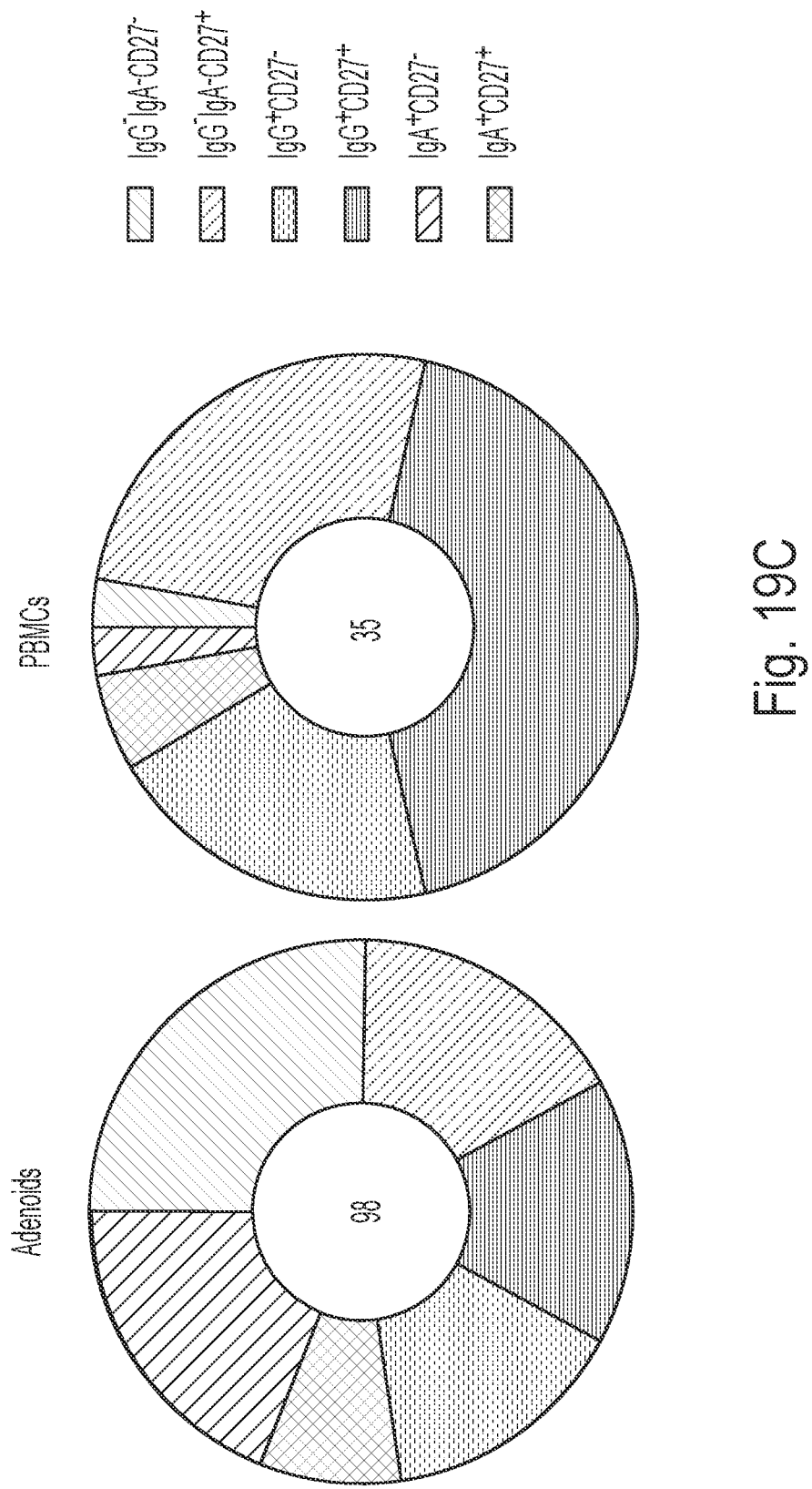
Figure 19D:
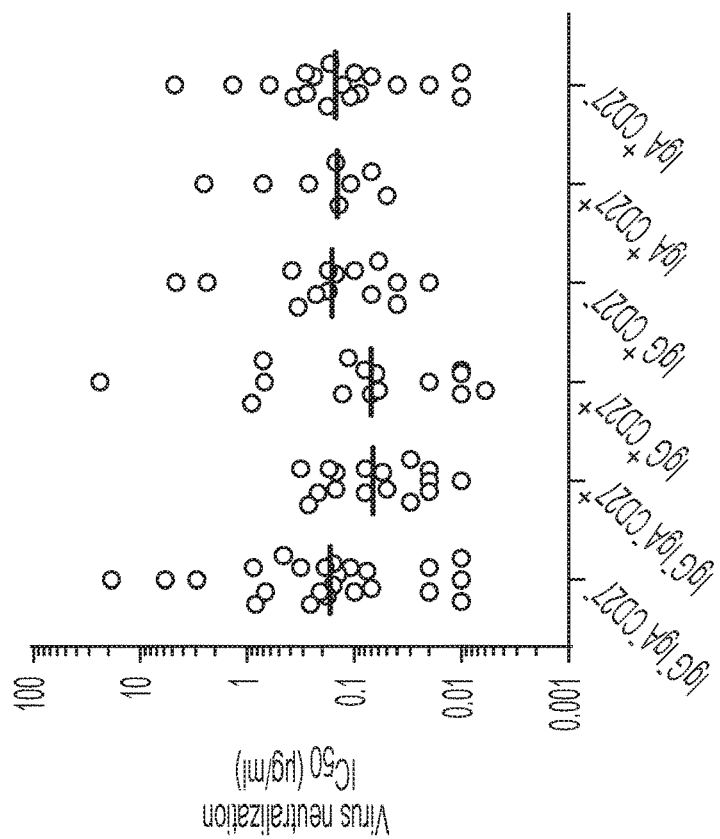
Figure 19D:
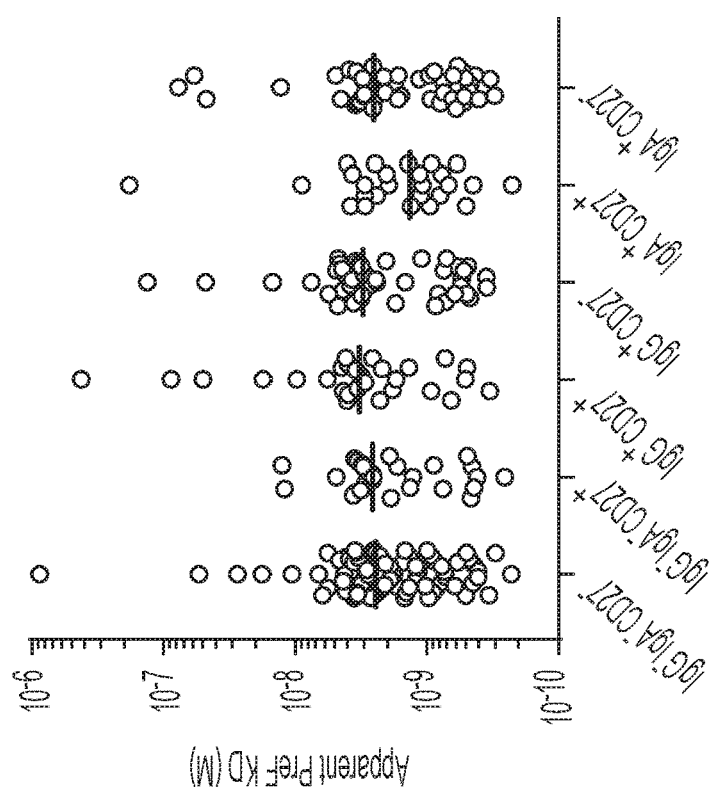

Finally, the relationship between memory B cell subset and neutralizing activity was analyzed. Approximately 90% of the PBMC-derived neutralizing antibodies originated from only three B cell subsets (IgG$^+$CD27$^+$, IgG$^+$ CD27$^-$, and IgG$^-$IgA$^-$CD27$^+$ B cells). In contrast, the adenoid-derived neutralizing antibodies were more evenly distributed across the six different memory B cell populations, with the largest proportion (25%) originating from the atypical IgG$^-$IgA$^-$CD27$^-$ memory B cell subset (FIG. 19C). The antibodies isolated from this atypical memory B cell subset showed similar apparent binding affinities and neutralization potencies compared to the antibodies derived from other memory B cell subsets. These findings demonstrate that 1) adenoid tissue contains a larger proportion of high affinity neutralizing antibodies compared to peripheral blood, 2) a relatively large fraction of RSV F-specific adenoid-derived neutralizing antibodies originate from atypical memory B cells, and 3) the vast majority of neutralizing antibodies isolated from both compartments target epitopes exclusively expressed on preF.

TABLE 6

Summary of antibody characteristics for antibodies isolated from adenoid tissue

| Name | Donor | RSV preF KD | RSV postF KD | Neutralization IC50 (RSV subtype A) | Specificitiy | PSR score | VH Germline | VL Germline | VH Protein Muts | VL Protein Muts |
|---|---|---|---|---|---|---|---|---|---|---|
| ADI-36669 | 2635 | 1.09E-09 | N.B. | 0.02 | preF | 0.01 | VH1-46 | VK1-17 | 11 | 1 |
| ADI-36670 | 2635 | 7.49E-10 | N.B. | 0.01 | preF | 0.01 | VH1-69 | VK3-15 | 17 | 5 |
| ADI-36671 | 2635 | 7.28E-10 | N.B. | 0.01 | preF | 0.05 | VH3-11 | VL1-40 | 11 | 5 |
| ADI-36672 | 2635 | 7.03E-10 | N.B. | 0.02 | preF | 0.07 | VH3-11 | VL1-40 | 13 | 6 |
| ADI-36674 | 2635 | 7.45E-10 | N.B. | 0.01 | preF | 0.01 | VH3-21 | VL1-40 | 9 | 8 |
| ADI-36677 | 2635 | 5.40E-10 | N.B. | 0.02 | preF | 0.05 | VH3-48 | VK1-33 | 8 | 6 |
| ADI-36679 | 2635 | 8.78E-10 | N.B. | 0.01 | preF | 0.10 | VH5-51 | VK1-33 | 13 | 12 |
| ADI-36680 | 2635 | 7.19E-10 | N.B. | 0.01 | preF | 0.10 | VH5-51 | VK3-15 | 10 | 10 |
| ADI-36681 | 2635 | 1.20E-09 | N.B. | 0.01 | preF | 0.08 | VH5-51 | VK3-15 | 8 | 9 |
| ADI-41144 | 2635 | 9.40E-10 | 7.59E-10 | 0.37 | Both | 0.52 | VH1-2 | VK1-16 | 14 | 7 |
| ADI-41145 | 2635 | 3.18505E-09 | 8.14745E-10 | >25 | Both | 0.24 | VH4-59 | VK1-39 | 4 | 3 |
| ADI-41146 | 2635 | 4.44E-09 | 7.46E-10 | >25 | Both | 0.23 | VH5-51 | VK1-12 | 14 | 7 |
| ADI-41147 | 2635 | 4.6744E-10 | N.B. | 0.06 | preF | 0.21 | VH3-11 | VL1-40 | 10 | 7 |
| ADI-41149 | 2635 | 4.34E-09 | 8.57E-10 | >25 | Both | 0.16 | VH3-33 | VK3-15 | 6 | 6 |
| ADI-41153 | 2635 | 9.27936E-10 | 4.45077E-10 | >25 | Both | 0.14 | VH3-21 | VK1-39 | 17 | 12 |
| ADI-41154 | 2635 | 4.63E-09 | 1.35E-09 | >25 | Both | 0.14 | VH4-34 | VK1-39 | 9 | 7 |
| ADI-41155 | 2635 | 3.51668E-09 | 4.77633E-10 | >25 | Both | 0.13 | VH4-39 | VL1-47 | 10 | 5 |
| ADI-41156 | 2635 | N.B. | 1.69623E-09 | >25 | PostF | 0.133957365 | VH3-48 | VK1-39 | 4 | 9 |
| ADI-41157 | 2635 | 5.07E-10 | N.B. | 0.22 | preF | 0.13 | VH4-59 | VL1-47 | 6 | 13 |
| ADI-41158 | 2635 | 4.48646E-09 | N.B. | >25 | preF | 0.13 | VH3-48 | VK3-15 | 9 | 0 |
| ADI-41159 | 2635 | N.B. | 9.86775E-09 | >25 | PostF | 0.13 | VH5-51 | VK1-39 | 4 | 4 |
| ADI-41160 | 2635 | 2.41078E-09 | 3.36863E-10 | >25 | Both | 0.13 | VH1-69 | VL2-14 | 3 | 8 |
| ADI-41161 | 2635 | 2.53811E-09 | 3.63868E-10 | >25 | Both | 0.12 | VH3-48 | VL2-14 | 12 | 12 |
| ADI-41162 | 2635 | 4.06E-09 | 7.48E-10 | >25 | Both | 0.12 | VH1-69 | VK3-20 | 12 | 6 |
| ADI-41163 | 2635 | 4.65418E-09 | 6.03726E-10 | >25 | Both | 0.12 | VH3-33 | VK2-28 | 14 | 5 |
| ADI-41164 | 2635 | N.B. | 9.61753E-10 | >25 | PostF | 0.12 | VH3-48 | VK1-5 | 10 | 14 |
| ADI-41165 | 2635 | 2.40E-09 | N.B. | >25 | preF | 0.11 | VH5-51 | VK1-33 | 0 | 0 |
| ADI-41166 | 2635 | 3.15262E-09 | 4.40318E-10 | >25 | Both | 0.11 | VH1-2 | VL2-14 | 19 | 12 |
| ADI-41168 | 2635 | 1.33E-07 | N.B. | >25 | preF | 0.11 | VH3-30 | VL2-14 | 1 | 10 |
| ADI-41169 | 2635 | 4.94324E-09 | 1.18611E-09 | >25 | Both | 0.11 | VH5-51 | VK4-1 | 13 | 6 |
| ADI-41170 | 2635 | 5.67E-09 | 2.64E-09 | >25 | Both | 0.11 | VH3-23 | VK1-5 | 12 | 6 |
| ADI-41171 | 2635 | 9.80E-09 | 4.26E-09 | >25 | Both | 0.11 | VH4-31 | VK3-20 | 17 | 9 |
| ADI-41172 | 2635 | 3.05696E-09 | 7.48831E-10 | >25 | Both | 0.11 | VH3-64D | VK4-1 | 10 | 3 |
| ADI-41173 | 2635 | 3.15494E-10 | 2.93512E-10 | 0.08 | Both | 0.11 | VH1-69 | VK1-17 | 9 | 3 |
| ADI-41174 | 2635 | N.B. | 7.51319E-10 | >25 | PostF | 0.11 | VH1-18 | VL3-25 | 11 | 6 |
| ADI-41175 | 2635 | 4.25E-09 | 1.07E-09 | >25 | Both | 0.10 | VH3-33 | VK2-28 | 7 | 2 |
| ADI-41176 | 2635 | N.B. | 4.07E-09 | >25 | PostF | 0.10 | VH4-39 | VK1-27 | 13 | 6 |
| ADI-41177 | 2635 | 8.37277E-10 | N.B. | >25 | preF | 0.10 | VH1-2 | VL1-44 | 5 | 4 |
| ADI-41178 | 2635 | 1.71747E-09 | 6.01837E-10 | >25 | Both | 0.10 | VH1-2 | VK3-15 | 3 | 0 |
| ADI-41179 | 2635 | 9.48366E-10 | 3.4151E-10 | >25 | Both | 0.10 | VH1-69 | VL2-11 | 9 | 19 |
| ADI-41180 | 2635 | 4.70488E-10 | N.B. | 0.07 | preF | 0.10 | VH3-11 | VL1-40 | 8 | 9 |
| ADI-41181 | 2635 | 1.95174E-09 | 9.35655E-10 | >25 | Both | 0.10 | VH1-69 | VL2-14 | 7 | 8 |
| ADI-41182 | 2635 | 2.5543E-09 | 4.62114E-10 | >25 | Both | 0.10 | VH5-51 | VK3-15 | 6 | 6 |
| ADI-41183 | 2635 | 4.08E-09 | 1.00E-09 | >25 | Both | 0.10 | VH4-34 | VK1-39 | 15 | 13 |
| ADI-41184 | 2635 | 2.84503E-09 | 5.31986E-10 | >25 | Both | 0.10 | VH3-23 | VK1-39 | 7 | 5 |
| ADI-41185 | 2635 | 3.22683E-9 | 8.08927E-10 | >25 | Both | 0.10 | VH4-34 | VK3-20 | 5 | 6 |
| ADI-41186 | 2635 | 3.01027E-09 | 7.03469E-10 | >25 | Both | 0.10 | VH5-51 | VK3-15 | 4 | 5 |
| ADI-41188 | 2635 | 2.23985E-10 | N.B. | 0.15 | preF | 0.10 | VH4-34 | VL1-40 | 8 | 12 |
| ADI-41189 | 2635 | 2.86473E-09 | 6.07729E-10 | >25 | Both | 0.10 | VH3-21 | VL1-40 | 4 | 1 |
| ADI-41190 | 2635 | 2.29E-09 | 9.71E-10 | >25 | Both | 0.08 | VH1-3 | VK3-20 | 9 | 5 |
| ADI-41191 | 2635 | 5.01606E-10 | N.B. | 0.07 | preF | 0.08 | VH1-18 | VK2-30 | 8 | 6 |
| ADI-41192 | 2635 | 3.38603E-09 | 5.89066E-10 | >25 | Both | 0.07 | VH1-18 | VK1-39 | 12 | 3 |
| ADI-41193 | 2635 | 7.40214E-10 | N.B. | 0.07 | preF | 0.07 | VH3-11 | VL1-40 | 13 | 8 |
| ADI-41194 | 2635 | N.B. | 1.16E-09 | >25 | PostF | 0.07 | VH4-31 | VK3-20 | 10 | 7 |
| ADI-41196 | 2635 | 2.9157E-09 | 5.95141E-10 | >25 | Both | 0.07 | VH3-23 | VK1-39 | 12 | 3 |
| ADI-41197 | 2635 | 7.95E-10 | 5.31E-10 | 0.27 | Both | 0.07 | VH1-2 | VK1-39 | 12 | 5 |
| ADI-41198 | 2635 | 7.56E-10 | N.B. | 0.32 | preF | 0.06 | VH3-43 | VK1-33 | 18 | 12 |
| ADI-41199 | 2635 | 1.73E-09 | N.B. | 0.23 | preF | 0.06 | VH3-11 | VK3-15 | 7 | 24 |

TABLE 6-continued

Summary of antibody characteristics for antibodies isolated from adenoid tissue

| Name | Donor | RSV preF KD | RSV postF KD | Neutralization IC50 (RSV subtype A) | Specificitiy | PSR score | VH Germline | VL Germline | VH Protein Muts | VL Protein Muts |
|---|---|---|---|---|---|---|---|---|---|---|
| ADI-41200 | 2635 | 3.34299E-10 | 3.18362E-10 | >25 | Both | 0.05 | VH3-23 | VK2-28 | 14 | 9 |
| ADI-41201 | 2635 | 3.82297E-09 | 6.37241E-10 | >25 | Both | 0.05 | VH3-48 | VK3-11 | 15 | 9 |
| ADI-41202 | 2635 | 1.12088E-09 | 3.32852E-10 | >25 | Both | 0.05 | VH1-69 | VL2-11 | 9 | 19 |
| ADI-41203 | 2635 | 3.99236E-10 | N.B. | 0.01 | preF | 0.05 | VH5-51 | VK3-15 | 9 | 10 |
| ADI-41204 | 2635 | 5.44567E-10 | N.B. | 0.06 | preF | 0.04 | VH3-21 | VL1-40 | 3 | 3 |
| ADI-41205 | 2635 | 1.16405E-09 | 5.3591E-10 | >25 | Both | 0.04 | VH4-4 | VK4-1 | 3 | 6 |
| ADI-41206 | 2635 | 4.09075E-10 | N.B. | 0.07 | preF | 0.04 | VH3-21 | VL1-40 | 11 | 10 |
| ADI-41207 | 2635 | 2.53175E-09 | 4.37767E-10 | >25 | Both | 0.04 | VH2-70 | VL2-11 | 3 | 13 |
| ADI-41208 | 2635 | 4.83434E-10 | N.B. | 0.08 | preF | 0.04 | VH3-11 | VL1-40 | 11 | 7 |
| ADI-41209 | 2635 | 1.32E-09 | 1.59E-09 | 2.97 | Both | 0.03 | VH4-34 | VK2-28 | 11 | 3 |
| ADI-41210 | 2635 | 4.70023E-10 | N.B. | 0.10 | preF | 0.02 | VH1-18 | VK2-30 | 7 | 4 |
| ADI-41212 | 2635 | 3.17532E-09 | 4.00134E-10 | >25 | Both | 0.02 | VH1-2 | VL2-14 | 11 | 13 |
| ADI-41213 | 2635 | 3.4719E-09 | 5.76926E-10 | >25 | Both | 0.02 | VH3-53 | VL3-1 | 4 | 2 |
| ADI-41214 | 2635 | 5.6989E-09 | 1.01699E-09 | >25 | Both | 0.01 | VH3-7 | VK1-39 | 4 | 5 |
| ADI-41215 | 2635 | 4.37E-10 | 5.63E-10 | 0.32 | Both | 0.01 | VH3-20 | VL2-23 | 3 | 10 |
| ADI-41216 | 2635 | 9.03E-10 | N.B. | 0.19 | preF | 0.01 | VH3-11 | VL1-40 | 9 | 8 |
| ADI-41217 | 2635 | 4.88862E-10 | N.B. | 0.04 | preF | 0.01 | VH3-21 | VL1-40 | 7 | 5 |
| ADI-41218 | 2635 | N.B. | 7.28659E-10 | >25 | PostF | 0.01 | VH1-18 | VL1-40 | 10 | 7 |
| ADI-41219 | 2635 | N.B. | 1.28064E-09 | >25 | PostF | 0.01 | VH3-48 | VK1-39 | 7 | 4 |
| ADI-41221 | 2635 | 2.98426E-10 | 3.16654E-10 | 0.04 | Both | 0.01 | VH3-21 | VL2-11 | 8 | 18 |
| ADI-41222 | 2635 | 4.30995E-10 | N.B. | 0.02 | preF | 0.01 | VH3-30 | VL3-21 | 10 | 11 |
| ADI-41223 | 2635 | N.B. | 1.80931E-09 | >25 | PostF | 0.00 | VH3-30 | VL2-14 | 6 | 11 |
| ADI-41224 | 2635 | 5.24E-09 | 5.58E-10 | 0.13 | Both | 0.00 | VH3-49 | VL6-57 | 7 | 5 |
| ADI-41225 | 2635 | 4.15E-09 | 7.33E-10 | >25 | Both | 0.00 | VH3-11 | VK1-5 | 11 | 8 |
| ADI-41226 | 2635 | 8.20E-10 | N.B. | 0.15 | preF | 0.00 | VH3-11 | VL1-40 | 15 | 2 |
| ADI-41227 | 2635 | 4.62E-09 | N.B. | >25 | preF | 0.00 | VH1-69 | VL1-36 | 19 | 0 |
| ADI-41228 | 2635 | 4.86239E-10 | 6.1786E-10 | >25 | Both | 0.00 | VH4-59 | VL2-14 | 6 | 3 |
| ADI-41229 | 2635 | 1.14E-09 | 7.08E-10 | 0.07 | Both | 0.00 | VH3-30 | VK1-33 | 10 | 3 |
| ADI-41230 | 2635 | 1.83E-09 | 4.07E-10 | 24.10 | Both | 0.00 | VH5-51 | VL6-57 | 11 | 3 |
| ADI-41231 | 2635 | 3.05E-09 | 4.26E-10 | >25 | Both | 0.00 | VH5-51 | VL6-57 | 14 | 8 |
| ADI-41232 | 2635 | 7.05E-10 | N.B. | 0.03 | preF | 0.00 | VH1-18 | VK2-30 | 6 | 1 |
| ADI-41233 | 2635 | 1.06E-09 | N.B. | 0.15 | preF | 0.00 | VH3-11 | VL1-40 | 5 | 3 |
| ADI-41234 | 2635 | 1.46E-09 | N.B. | 0.10 | preF | 0.00 | VH3-30 | VK2-28 | 47 | 4 |
| ADI-41235 | 2635 | 4.72E-09 | 3.24E-09 | >25 | Both | 0.00 | VH4-34 | VL1-40 | 8 | 7 |
| ADI-41236 | 2635 | N.B. | 6.13E-08 | >25 | PostF | 0.00 | VH3-11 | VL1-40 | 7 | 14 |
| ADI-41237 | 2635 | 7.94E-10 | N.B. | 0.04 | preF | 0.00 | VH3-11 | VL1-40 | 5 | 3 |
| ADI-41238 | 2635 | 1.03E-09 | N.B. | 0.13 | preF | 0.00 | VH3-11 | VL1-40 | 5 | 6 |
| ADI-41239 | 2635 | 4.25E-09 | 1.47E-09 | >25 | Both | 0.00 | VH2-5 | VK2-28 | 6 | 1 |
| ADI-41240 | 2635 | 2.15E-09 | 1.20E-09 | >25 | Both | 0.00 | VH4-34 | VK1-5 | 13 | 10 |
| ADI-41241 | 2635 | 3.84E-09 | 9.27E-10 | 18.76 | Both | 0.00 | VH1-2 | VK1-39 | 4 | 6 |
| ADI-41242 | 2635 | 4.18E-09 | 9.07E-10 | >25 | Both | 0.00 | VH3-33 | VK2-28 | 12 | 2 |
| ADI-41243 | 2635 | 3.55E-09 | 4.18E-10 | >25 | Both | 0.00 | VH5-51 | VL6-57 | 9 | 4 |
| ADI-41244 | 2635 | N.B. | 8.43E-10 | >25 | PostF | 0.00 | VH3-53 | VK4-1 | 7 | 6 |
| ADI-41245 | 2635 | 7.75E-10 | N.B. | 0.71 | preF | 0.00 | VH3-11 | VL1-40 | 8 | 2 |
| ADI-41246 | 2635 | 3.07945E-09 | N.B. | >25 | preF | 0.00 | VH4-59 | VK3-20 | 4 | 6 |
| ADI-41247 | 2635 | 2.76078E-09 | 1.0202E-09 | >25 | Both | 0.00 | VH1-2 | VL6-57 | 10 | 1 |
| ADI-41248 | 2635 | 3.35413E-09 | 3.91839E-10 | >25 | Both | 0.00 | VH3-33 | VK1-39 | 7 | 5 |
| ADI-41249 | 2635 | 3.91497E-10 | N.B. | 0.01 | preF | 0.00 | VH5-51 | VK1-33 | 14 | 4 |
| ADI-41250 | 2635 | 7.30505E-10 | 5.04204E-10 | >25 | Both | 0.00 | VH4-34 | VL2-14 | 10 | 8 |
| ADI-41251 | 2635 | 5.92669E-10 | N.B. | 0.11 | preF | 0.00 | VH3-11 | VL1-40 | 5 | 2 |
| ADI-41252 | 2635 | 1.3715E-09 | 1.00354E-09 | >25 | Both | 0.00 | VH5-51 | VK1-33 | 11 | 2 |
| ADI-41253 | 2635 | 1.11084E-09 | N.B. | 0.03 | preF | 0.00 | VH4-39 | VK3-20 | 19 | 8 |
| ADI-41254 | 2635 | 7.75513E-10 | N.B. | >25 | preF | 0.00 | VH3-48 | VL1-44 | 8 | 8 |
| ADI-41255 | 2635 | 2.04133E-09 | 1.54027E-09 | >25 | Both | 0.00 | VH3-23 | VK3-15 | 6 | 3 |
| ADI-41256 | 2635 | 3.53762E-10 | N.B. | 0.02 | preF | 0.00 | VH1-69 | VK2-30 | 18 | 3 |
| ADI-41257 | 2635 | 3.81012E-09 | N.B. | >25 | preF | 0.00 | VH1-69 | VK1-39 | 10 | 6 |
| ADI-41258 | 2635 | 9.68014E-11 | N.B. | >25 | preF | 0.00 | VH3-23 | VL3-25 | 12 | 2 |
| ADI-41259 | 2635 | 3.35934E-10 | N.B. | 0.02 | preF | 0.00 | VH3-11 | VK2-30 | 9 | 8 |
| ADI-41261 | 2665 | 3.08217E-09 | 1.66794E-09 | >25 | Both | 0.33 | VH1-69 | VK3-20 | 7 | 0 |
| ADI-41263 | 2665 | 2.90427E-09 | 3.45081E-10 | >25 | Both | 0.25 | VH1-46 | VL6-57 | 13 | 5 |
| ADI-41264 | 2665 | N.B. | 4.83588E-10 | >25 | PostF | 0.15 | VH3-15 | VL3-10 | 9 | 13 |
| ADI-41265 | 2665 | 1.50426E-08 | 3.0791E-09 | >25 | Both | 0.15 | VH5-51 | VL1-51 | 15 | 6 |
| ADI-41266 | 2665 | 4.05839E-09 | N.B. | >25 | preF | 0.14 | VH6-1 | VL3-21 | 0 | 11 |
| ADI-41267 | 2665 | 1.0722E-08 | 1.09048E-08 | >25 | Both | 0.12 | VH4-4 | VL3-1 | 6 | 10 |
| ADI-41268 | 2665 | 5.80544E-10 | N.B. | 0.176867623 | preF | 0.11 | VH3-21 | VL2-14 | 12 | 7 |
| ADI-41270 | 2665 | 4.91907E-09 | 6.17282E-10 | >25 | Both | 0.11 | VH3-30-3 | VL2-23 | 5 | 5 |
| ADI-41271 | 2665 | N.B. | 3.11283E-09 | >25 | PostF | 0.11 | VH6-1 | VK4-1 | 2 | 3 |
| ADI-41273 | 2665 | 3.06182E-09 | 1.17234E-09 | >25 | Both | 0.11 | VH3-48 | VL2-11 | 17 | 12 |
| ADI-41274 | 2665 | 4.79702E-10 | N.B. | 0.109081031 | preF | 0.10 | VH3-21 | VL1-40 | 11 | 10 |
| ADI-41275 | 2665 | 5.74247E-09 | 1.32887E-09 | >25 | Both | 0.10 | VH3-21 | VK2-28 | 14 | 7 |
| ADI-41276 | 2665 | N.B. | 3.14914E-09 | >25 | PostF | 0.10 | VH3-49 | VK3-20 | 7 | 2 |
| ADI-41277 | 2665 | 3.59859E-09 | 7.80097E-10 | >25 | Both | 0.10 | VH4-4 | VK1-39 | 12 | 6 |
| ADI-41278 | 2665 | 1.28256E-09 | 4.82496E-10 | >25 | Both | 0.10 | VH2-70D | VK1-39 | 7 | 8 |
| ADI-41279 | 2665 | 5.04148E-08 | 4.78337E-08 | >25 | Both | 0.10 | VH5-51 | VL1-40 | 16 | 10 |

TABLE 6-continued

Summary of antibody characteristics for antibodies isolated from adenoid tissue

| Name | Donor | RSV preF KD | RSV postF KD | Neutralization IC50 (RSV subtype A) | Specificitiy | PSR score | VH Germline | VL Germline | VH Protein Muts | VL Protein Muts |
|---|---|---|---|---|---|---|---|---|---|---|
| ADI-41280 | 2665 | 3.62407E-09 | 4.82968E-10 | >25 | Both | 0.10 | VH4-59 | VK3-20 | 8 | 8 |
| ADI-41281 | 2665 | 6.69584E-09 | 1.57901E-09 | >25 | Both | 0.10 | VH1-3 | VK1-39 | 18 | 12 |
| ADI-41282 | 2665 | 3.24641E-09 | 1.25067E-09 | >25 | Both | 0.10 | VH3-30-3 | VK3-20 | 11 | 9 |
| ADI-41283 | 2665 | 2.74028E-08 | 7.95247E-09 | >25 | Both | 0.10 | VH2-5 | VK1-39 | 4 | 14 |
| ADI-41284 | 2665 | 3.05821E-09 | 5.47248E-10 | >25 | Both | 0.10 | VH3-15 | VL1-51 | 9 | 3 |
| ADI-41285 | 2665 | 5.11231E-10 | 4.12147E-10 | >25 | Both | 0.10 | VH1-69 | VL1-47 | 12 | 3 |
| ADI-41286 | 2665 | 7.59591E-09 | 5.48535E-09 | >25 | Both | 0.10 | VH1-18 | VK1-12 | 4 | 6 |
| ADI-41287 | 2665 | 3.22264E-09 | 5.97933E-10 | 5.845176257 | Both | 0.09 | VH3-9 | VL2-11 | 10 | 4 |
| ADI-41288 | 2665 | 8.99143E-09 | N.B. | >25 | preF | 0.08 | VH3-23 | VK3-20 | 14 | 12 |
| ADI-41289 | 2665 | N.B. | 8.81474E-10 | >25 | PostF | 0.08 | VH5-51 | VL2-23 | 8 | 10 |
| ADI-41290 | 2665 | 2.9847E-09 | 1.20178E-09 | >25 | Both | 0.07 | VH4-34 | VK1-39 | 16 | 9 |
| ADI-41292 | 2665 | 8.83038E-07 | 1.94972E-07 | >25 | Both | 0.06 | VH3-30 | VK1-5 | 10 | 12 |
| ADI-41293 | 2665 | 4.95631E-10 | 4.10968E-10 | 0.159400369 | Both | 0.05 | VH4-30-4 | VK3-20 | 6 | 6 |
| ADI-41294 | 2665 | 5.11755E-10 | N.B. | 0.080516504 | preF | 0.05 | VH3-48 | VL2-8 | 10 | 9 |
| ADI-41295 | 2665 | 3.35264E-09 | N.B. | >25 | preF | 0.04 | VH5-51 | VL3-25 | 20 | 19 |
| ADI-41297 | 2665 | 3.90841E-09 | 6.27923E-10 | >25 | Both | 0.04 | VH1-69 | VL2-14 | 5 | 6 |
| ADI-41299 | 2665 | 3.48237E-09 | 2.24822E-09 | >25 | Both | 0.04 | VH3-30 | VL2-23 | 14 | 12 |
| ADI-41302 | 2665 | 6.54219E-10 | N.B. | 0.006 | preF | 0.03 | VH3-30 | VL2-8 | 10 | 7 |
| ADI-41303 | 2665 | 2.95589E-09 | 9.43837E-10 | >25 | Both | 0.03 | VH3-23 | VK3-20 | 18 | 14 |
| ADI-41304 | 2665 | 3.37926E-09 | 3.30067E-10 | >25 | Both | 0.03 | VH4-30-4 | VL1-44 | 9 | 9 |
| ADI-41305 | 2665 | 3.63645E-09 | 4.31019E-10 | >25 | Both | 0.03 | VH4-31 | VK3-20 | 7 | 4 |
| ADI-41306 | 2665 | 4.61555E-10 | 4.54221E-10 | 0.173227379 | Both | 0.02 | VH4-30-4 | VK3-11 | 21 | 10 |
| ADI-41307 | 2665 | 2.98694E-09 | 8.29508E-10 | >25 | Both | 0.02 | VH3-21 | VK3-15 | 15 | 14 |
| ADI-41308 | 2665 | 4.00249E-09 | 5.18915E-10 | >25 | Both | 0.02 | VH6-1 | VL2-14 | 4 | 15 |
| ADI-41309 | 2665 | 4.33574E-09 | 1.36177E-09 | >25 | Both | 0.02 | VH4-30-4 | VK3-20 | 8 | 4 |
| ADI-41310 | 2665 | 3.3197E-09 | N.B. | >25 | preF | 0.02 | VH5-51 | VL3-25 | 18 | 22 |
| ADI-41311 | 2665 | 7.53678E-10 | 5.24E-10 | >25 | Both | 0.01 | VH2-70 | VK1-39 | 7 | 8 |
| ADI-41312 | 2665 | 3.37922E-09 | 8.56857E-10 | >25 | Both | 0.01 | VH4-4 | VL1-44 | 8 | 2 |
| ADI-41313 | 2665 | 4.54784E-10 | 3.41756E-10 | >25 | Both | 0.01 | VH1-18 | VL3-9 | 11 | 13 |
| ADI-41314 | 2665 | 2.40926E-09 | 4.14355E-10 | >25 | Both | 0.01 | VH1-69 | VL3-25 | 13 | 18 |
| ADI-41315 | 2665 | 2.93399E-09 | 1.0343E-09 | >25 | Both | 0.01 | VH4-59 | VK3-20 | 8 | 5 |
| ADI-41316 | 2665 | 3.73659E-09 | 1.04515E-09 | >25 | Both | 0.01 | VH3-30 | VK3-15 | 9 | 5 |
| ADI-41317 | 2665 | 4.81624E-08 | N.B. | 4.657687235 | preF | 0.01 | VH3-7 | VL1-40 | 12 | 11 |
| ADI-41318 | 2665 | 4.26427E-07 | 3.53944E-08 | >25 | Both | 0.01 | VH1-69 | VK1-13 | 16 | 9 |
| ADI-41319 | 2665 | 4.4099E-09 | 5.86603E-10 | >25 | Both | 0.01 | VH4-30-4 | VK3-20 | 4 | 4 |
| ADI-41320 | 2665 | 3.20131E-09 | N.B. | >25 | preF | 0.01 | VH5-51 | VL3-25 | 24 | 18 |
| ADI-41322 | 2665 | 2.98155E-09 | N.B. | >25 | preF | 0.00 | VH1-69 | VK1-12 | 9 | 3 |
| ADI-41323 | 2665 | 1.94986E-09 | 3.30643E-10 | >25 | Both | 0.00 | VH3-20 | VL6-57 | 10 | 5 |
| ADI-41324 | 2665 | 2.4749E-09 | 4.26392E-10 | >25 | Both | 0.00 | VH3-66 | VK3-20 | 4 | 6 |
| ADI-41340 | 2665 | 3.50828E-09 | N.B. | >25 | preF | 0.00 | VH1-69 | VL2-14 | 18 | 11 |
| ADI-41341 | 2665 | 2.83245E-09 | 1.96942E-09 | >25 | Both | 0.00 | VH1-69 | VL1-51 | 6 | 9 |
| ADI-41342 | 2665 | 3.99333E-09 | 5.90775E-10 | >25 | Both | 0.00 | VH1-69 | VK3-20 | 9 | 7 |
| ADI-41343 | 2665 | 7.21165E-10 | N.B. | 0.177309561 | preF | 0.00 | VH3-21 | VL1-40 | 5 | 3 |
| ADI-41344 | 2665 | 4.94249E-10 | N.B. | 0.063680457 | preF | 0.00 | VH3-21 | VL1-40 | 7 | 4 |
| ADI-41345 | 2665 | 2.28687E-09 | 3.48826E-10 | >25 | Both | 0.00 | VH5-51 | VL6-57 | 7 | 2 |
| ADI-41346 | 2665 | 1.88377E-09 | 2.67433E-10 | >25 | Both | 0.00 | VH5-51 | VL6-57 | 15 | 9 |
| ADI-41347 | 2665 | 2.60039E-09 | 5.2114E-10 | >25 | Both | 0.00 | VH4-4 | VK2-28 | 11 | 5 |
| ADI-41348 | 2665 | 4.75842E-10 | 4.3847E-10 | 0.076469111 | Both | 0.00 | VH4-31 | VK1-39 | 3 | 9 |
| ADI-41349 | 2665 | 6.24824E-09 | | >25 | Both | 0.00 | VH3-49 | VK1-33 | 12 | 8 |
| ADI-41350 | 2665 | N.B. | 6.01842E-10 | >25 | PostF | 0.00 | VH3-23 | VL2-14 | 4 | 9 |
| ADI-41351 | 2665 | 8.86433E-10 | N.B. | 0.148889821 | preF | 0.00 | VH3-64 | VK3-15 | 15 | 3 |
| ADI-41352 | 2665 | 3.35674E-09 | N.B. | >25 | preF | 0.00 | VH3-48 | VK4-1 | 4 | 0 |
| ADI-41353 | 2665 | 3.90918E-09 | N.B. | >25 | preF | 0.00 | VH5-51 | VL3-25 | 19 | 17 |
| ADI-41354 | 2665 | 7.71337E-10 | 4.28593E-10 | >25 | Both | 0.00 | VH3-23 | VK1-33 | 2 | 19 |
| ADI-41355 | 2665 | 3.84279E-09 | 1.17814E-09 | >25 | Both | 0.00 | VH3-11 | VL3-21 | 10 | 11 |
| ADI-41356 | 2665 | 7.24816E-10 | N.B. | 0.115429214 | preF | 0.00 | VH1-8 | VL3-1 | 4 | 7 |
| ADI-41357 | 2665 | 3.30683E-09 | N.B. | >25 | preF | 0.00 | VH3-48 | VK1-16 | 7 | 4 |
| ADI-41358 | 2665 | 8.64199E-10 | N.B. | 0.388841883 | preF | 0.00 | VH3-21 | VL1-40 | 5 | 4 |
| ADI-41359 | 2665 | 5.27247E-10 | N.B. | >25 | preF | 0.00 | VH3-21 | VL1-40 | 4 | 4 |
| ADI-41360 | 2665 | 2.45821E-09 | 3.58127E-10 | >25 | Both | 0.00 | VH3-48 | VL6-57 | 11 | 1 |
| ADI-41361 | 2665 | N.B. | 3.8252E-10 | 2.539820038 | PostF | 0.00 | VH3-30 | VK3-15 | 8 | 3 |
| ADI-41362 | 2665 | 3.37246E-09 | N.B. | 0.910656137 | preF | 0.00 | VH3-7 | VK1-33 | 14 | 11 |
| ADI-41363 | 2665 | 1.84993E-09 | N.B. | 0.143419355 | preF | 0.00 | VH1-69 | VK1-33 | 5 | 6 |
| ADI-41364 | 2665 | 1.31503E-09 | N.B. | 0.140467535 | preF | 0.00 | VH1-2 | VL2-23 | 17 | 6 |
| ADI-41365 | 2665 | 2.87064E-09 | 2.24411E-09 | >25 | Both | 0.00 | VH3-11 | VL1-40 | 7 | 8 |
| ADI-41366 | 2665 | 1.79472E-09 | 2.78051E-10 | >25 | Both | 0.00 | VH5-51 | VL6-57 | 10 | 8 |
| ADI-41367 | 2665 | 1.75638E-08 | 4.7231E-09 | >25 | Both | 0.00 | VH1-3 | VL2-14 | 19 | 13 |
| ADI-41368 | 2665 | 3.07672E-09 | 8.77542E-10 | >25 | Both | 0.00 | VH3-30 | VK1-5 | 14 | 9 |
| ADI-41369 | 2665 | 6.84843E-10 | 3.07855E-10 | >25 | Both | 0.00 | VH3-30 | VL6-57 | 6 | 4 |
| ADI-41370 | 2665 | 5.58964E-09 | 1.63921E-09 | >25 | Both | 0.00 | VH3-21 | VL3-25 | 6 | 6 |
| ADI-41371 | 2665 | 2.96473E-09 | 5.42686E-10 | >25 | Both | 0.00 | VH4-30-4 | VK3-20 | 14 | 11 |
| ADI-41372 | 2665 | 2.47619E-09 | 4.2465E-10 | >25 | Both | 0.00 | VH1-69 | VL3-25 | 8 | 19 |
| ADI-41373 | 2665 | 3.71092E-09 | 1.18174E-09 | >25 | Both | 0.00 | VH3-11 | VL1-40 | 15 | 7 |
| ADI-41374 | 2665 | 1.38715E-09 | 3.69047E-10 | >25 | Both | 0.00 | VH1-69 | VK1-33 | 17 | 9 |

TABLE 6-continued

Summary of antibody characteristics for antibodies isolated from adenoid tissue

| Name | Donor | RSV preF KD | RSV postF KD | Neutralization IC50 (RSV subtype A) | Specificitiy | PSR score | VH Germline | VL Germline | VH Protein Muts | VL Protein Muts |
|---|---|---|---|---|---|---|---|---|---|---|
| ADI-41375 | 2665 | 2.96439E−09 | 1.01798E−09 | >25 | Both | 0.00 | VH3-30 | VK1-13 | 8 | 8 |
| ADI-41376 | 2665 | 4.15159E−09 | 7.0539E−10 | >25 | Both | 0.00 | VH3-30 | VK3-15 | 8 | 4 |
| ADI-41377 | 2665 | 1.73768E−09 | N.B. | 0.239614261 | preF | 0.00 | VH6-1 | VL3-21 | 11 | 15 |
| ADI-41378 | 2665 | 2.98284E−09 | 7.38719E−10 | >25 | Both | 0.00 | VH4-4 | VK1-39 | 5 | 10 |
| ADI-41379 | 2665 | N.B. | 1.10788E−09 | >25 | PostF | 0.00 | VH5-51 | VK1-33 | 5 | 6 |
| ADI-41380 | 2665 | 2.56169E−10 | N.B. | 0.054916106 | preF | 0.00 | VH5-51 | VK1-33 | 0 | 4 |
| ADI-41381 | 2665 | 2.60472E−09 | 1.33733E−09 | >25 | Both | 0.00 | VH4-30-4 | VK3-20 | 13 | 5 |
| ADI-41382 | 2666 | 4.91343E−10 | N.B. | 0.02 | preF | 0.00 | VH3-9 | VK3-15 | 10 | 2 |
| ADI-41384 | 2666 | 3.45299E−09 | 5.63124E−10 | >25 | Both | 0.20 | VH1-69 | VK3-20 | 10 | 7 |
| ADI-41385 | 2666 | 4.52281E−09 | 6.00686E−10 | >25 | Both | 0.10 | VH3-33 | VL1-40 | 3 | 2 |
| ADI-41386 | 2666 | 4.03244E−09 | N.B. | >25 | preF | 0.10 | VH1-2 | VL1-44 | 11 | 7 |
| ADI-41389 | 2666 | 2.58276E−09 | 5.12803E−10 | >25 | Both | 0.10 | VH3-30-3 | VL3-25 | 7 | 1 |
| ADI-41390 | 2666 | 6.40545E−10 | N.B. | 0.62 | preF | 0.10 | VH3-21 | VL1-40 | 7 | 4 |
| ADI-41391 | 2666 | 8.82233E−10 | 4.78533E−10 | >25 | Both | 0.10 | VH4-59 | VL2-14 | 3 | 5 |
| ADI-41392 | 2666 | 3.29102E−10 | 3.58725E−10 | 0.18 | Both | 0.10 | VH3-30-3 | VL2-14 | 14 | 8 |
| ADI-41393 | 2666 | 1.66525E−09 | 2.46585E−10 | >25 | Both | 0.10 | VH5-51 | VL6-57 | 2 | 3 |
| ADI-41394 | 2666 | 3.06807E−09 | N.B. | >25 | preF | 0.10 | VH1-69 | VL4-60 | 11 | 9 |
| ADI-41396 | 2666 | 5.1704E−10 | N.B. | 1.37 | preF | 0.10 | VH3-21 | VL1-40 | 9 | 3 |
| ADI-41397 | 2666 | 5.81313E−10 | N.B. | 0.09 | preF | 0.10 | VH3-21 | VL1-40 | 10 | 2 |
| ADI-41398 | 2666 | 6.00144E−10 | N.B. | 0.17 | preF | 0.09 | VH1-18 | VK2-30 | 1 | 4 |
| ADI-41399 | 2666 | 3.14259E−09 | N.B. | >25 | preF | 0.09 | VH1-3 | VL2-14 | 3 | 5 |
| ADI-41400 | 2666 | N.B. | 5.47444E−10 | >25 | PostF | 0.09 | VH3-48 | VK1-5 | 8 | 4 |
| ADI-41401 | 2666 | 3.21615E−10 | N.B. | >25 | preF | 0.07 | VH3-9 | VK1-39 | 5 | 5 |
| ADI-41403 | 2666 | 3.04427E−09 | 8.41083E−10 | >25 | Both | 0.04 | VH3-21 | VK2-28 | 9 | 3 |
| ADI-41404 | 2666 | 4.73759E−08 | 1.3574E−08 | >25 | Both | 0.04 | VH1-69 | VK3-20 | 8 | 3 |
| ADI-41405 | 2666 | 2.72169E−09 | 4.58099E−10 | >25 | Both | 0.02 | VH3-48 | VK3-11 | 9 | 2 |
| ADI-41406 | 2666 | N.B. | 5.71343E−10 | >25 | PostF | 0.02 | VH3-23 | VK1-16 | 8 | 6 |
| ADI-41407 | 2666 | 2.08406E−09 | 3.71284E−10 | >25 | Both | 0.01 | VH3-23 | VK1-27 | 9 | 7 |
| ADI-41408 | 2666 | 2.13579E−09 | N.B. | >25 | preF | 0.00 | VH5-51 | VK1-33 | 9 | 7 |
| ADI-41409 | 2666 | 6.26652E−10 | N.B. | 0.29 | preF | 0.00 | VH1-18 | VK2-30 | 4 | 2 |
| ADI-41414 | 2666 | 2.70176E−09 | 1.1037E−09 | >25 | Both | 0.00 | VH3-66 | VK1-5 | 14 | 4 |
| ADI-41415 | 2666 | 1.08103E−09 | 6.43742E−10 | >25 | Both | 0.11 | VH2-70D | VK1-39 | 9 | 10 |
| ADI-41416 | 2666 | 4.43792E−10 | N.B. | 0.05 | preF | 0.10 | VH3-21 | VL1-40 | 8 | 5 |
| ADI-41417 | 2666 | 9.19338E−10 | N.B. | 0.71 | preF | 0.10 | VH3-21 | VL1-40 | 3 | 2 |
| ADI-41418 | 2666 | 1.58304E−09 | 3.41314E−10 | >25 | Both | 0.10 | VH3-15 | VL3-10 | 13 | 5 |
| ADI-41419 | 2666 | 3.0463E−10 | N.B. | 0.01 | preF | 0.10 | VH3-9 | VL2-14 | 4 | 6 |
| ADI-41420 | 2666 | N.B. | 1.09885E−07 | >25 | PostF | 0.10 | VH3-30-3 | VL2-18 | 0 | 0 |
| ADI-41421 | 2666 | 2.51681E−09 | N.B. | 4.78 | preF | 0.10 | VH1-18 | VL3-10 | 18 | 4 |
| ADI-41423 | 2666 | 5.86859E−08 | N.B. | >25 | preF | 0.10 | VH3-21 | VL2-14 | 0 | 1 |
| ADI-41424 | 2666 | 7.44001E−10 | N.B. | 0.28 | preF | 0.00 | VH1-18 | VK2-30 | 14 | 13 |
| ADI-41425 | 2666 | 1.13708E−09 | 4.96097E−10 | >25 | Both | 0.00 | VH2-70 | VK1-39 | 13 | 9 |
| ADI-41427 | 2666 | 2.69701E−09 | 9.17353E−10 | >25 | Both | 0.21 | VH4-59 | VL2-14 | 5 | 1 |
| ADI-41429 | 2666 | 3.61957E−09 | 1.00206E−09 | >25 | Both | 0.10 | VH1-69 | VL2-14 | 3 | 2 |
| ADI-41431 | 2666 | 7.44349E−10 | 3.44594E−10 | 2.38 | Both | 0.10 | VH1-18 | VL1-51 | 14 | 7 |
| ADI-41432 | 2666 | 2.04914E−09 | 2.86037E−10 | >25 | Both | 0.10 | VH1-69 | VL2-11 | 14 | 8 |
| ADI-41433 | 2666 | N.B. | 1.2267E−09 | >25 | PostF | 0.10 | VH3-30 | VL2-11 | 8 | 4 |
| ADI-41434 | 2666 | 6.13319E−10 | N.B. | >25 | preF | 0.10 | VH3-9 | VK3-15 | 5 | 3 |
| ADI-41435 | 2666 | N.B. | 3.47214E−09 | >25 | PostF | 0.10 | VH3-21 | VL1-44 | 6 | 4 |
| ADI-41436 | 2666 | 1.10343E−09 | 2.3675E−10 | >25 | Both | 0.10 | VH3-30-3 | VL6-57 | 11 | 5 |
| ADI-41437 | 2666 | 3.5009E−10 | N.B. | >25 | preF | 0.04 | VH1-18 | VK4-1 | 13 | 4 |
| ADI-41438 | 2666 | 3.1446E−09 | N.B. | >25 | preF | 0.00 | VH1-69 | VK3-15 | 22 | 11 |
| ADI-41439 | 2666 | 5.00975E−10 | N.B. | 0.34 | preF | 0.00 | VH1-18 | VK2-30 | 10 | 2 |
| ADI-41440 | 2666 | 3.18018E−09 | 1.23422E−09 | >25 | Both | 0.00 | VH3-21 | VK3-15 | 8 | 4 |
| ADI-41441 | 2666 | 3.11642E−09 | N.B. | >25 | preF | 0.00 | VH4-39 | VK1-9 | 12 | 5 |
| ADI-41442 | 2666 | 5.21389E−10 | N.B. | 0.04 | preF | 0.00 | VH3-9 | VK3D-15 | 3 | 3 |
| ADI-41443 | 2666 | 2.39989E−09 | 3.73358E−10 | >25 | Both | 0.00 | VH3-33 | VK2-28 | 7 | 7 |
| ADI-41444 | 2666 | 3.01394E−09 | 5.40812E−10 | >25 | Both | 0.00 | VH4-30-4 | VK1-5 | 17 | 10 |
| ADI-41445 | 2666 | 3.04263E−09 | 7.71859E−10 | >25 | Both | 0.19 | VH1-69 | VK3-20 | 17 | 6 |
| ADI-41446 | 2666 | 3.60473E−09 | 7.21955E−10 | >25 | Both | 0.12 | VH3-23 | VK3-11 | 10 | 6 |
| ADI-41447 | 2666 | 5.40998E−08 | N.B. | >25 | preF | 0.12 | VH3-23 | VK3-20 | 4 | 3 |
| ADI-41448 | 2666 | 2.74846E−09 | 4.28394E−10 | >25 | Both | 0.10 | VH1-69 | VL2-14 | 16 | 12 |
| ADI-41449 | 2666 | 5.07579E−10 | N.B. | 0.16 | preF | 0.10 | VH3-21 | VL1-40 | 10 | 5 |
| ADI-41450 | 2666 | 6.13101E−10 | N.B. | 0.21 | preF | 0.10 | VH3-21 | VL1-40 | 12 | 9 |
| ADI-41451 | 2666 | 1.82249E−09 | 1.66981E−09 | 0.84 | Both | 0.10 | VH3-48 | VL3-1 | 13 | 16 |
| ADI-41452 | 2666 | 3.33249E−09 | N.B. | >25 | preF | 0.10 | VH1-3 | VL2-14 | 19 | 6 |
| ADI-41453 | 2666 | 2.16827E−09 | 4.02833E−10 | >25 | Both | 0.10 | VH1-8 | VL3-9 | 8 | 4 |
| ADI-41454 | 2666 | 5.87531E−10 | N.B. | 0.88 | preF | 0.10 | VH1-18 | VK2-30 | 7 | 4 |
| ADI-41455 | 2666 | 1.52555E−09 | 6.37546E−10 | >25 | Both | 0.08 | VH4-30-4 | VK3-11 | 8 | 1 |
| ADI-41456 | 2666 | 1.48371E−09 | 2.66707E−10 | >25 | Both | 0.08 | VH3-74 | VL6-57 | 13 | 3 |
| ADI-41488 | 2849 | N.B. | 6.05E−10 | >25 | PostF | 0.10 | VH4-59 | VL2-11 | 12 | 6 |
| ADI-41489 | 2849 | 8.80E−08 | N.B. | >25 | preF | 0.10 | VH3-30 | VK3-15 | 13 | 6 |
| ADI-41491 | 2849 | 4.39E−10 | N.B. | >25 | preF | 0.08 | VH3-48 | VL3-21 | 7 | 4 |
| ADI-41492 | 2849 | 1.82E−07 | 5.48E−08 | >25 | Both | 0.07 | VH1-69 | VK1-39 | 11 | 6 |
| ADI-41493 | 2849 | 4.50E−10 | 3.72E−10 | >25 | Both | 0.06 | VH5-51 | VL2-8 | 5 | 2 |

TABLE 6-continued

Summary of antibody characteristics for antibodies isolated from adenoid tissue

| Name | Donor | RSV preF KD | RSV postF KD | Neutralization IC50 (RSV subtype A) | Specificitiy | PSR score | VH Germline | VL Germline | VH Protein Muts | VL Protein Muts |
|---|---|---|---|---|---|---|---|---|---|---|
| ADI-41494 | 2849 | 2.61E-09 | 4.40E-10 | >25 | Both | 0.06 | VH3-49 | VL2-14 | 16 | 7 |
| ADI-41495 | 2849 | 7.72E-08 | 5.73E-08 | >25 | Both | 0.05 | VH3-15 | VL6-57 | 12 | 4 |
| ADI-41496 | 2849 | 1.65E-09 | 1.37E-09 | >25 | Both | 0.04 | VH1-8 | VL2-23 | 3 | 6 |
| ADI-41497 | 2849 | 1.44E-09 | 2.68E-10 | >25 | Both | 0.04 | VH3-30 | VL3-21 | 12 | 7 |
| ADI-41498 | 2849 | 1.22E-09 | 2.20E-10 | >25 | Both | 0.04 | VH3-21 | VL3-21 | 13 | 4 |
| ADI-41499 | 2849 | 1.99E-09 | 2.97E-10 | >25 | Both | 0.04 | VH3-43 | VL2-11 | 13 | 9 |
| ADI-41501 | 2849 | 3.21E-09 | N.B. | >25 | preF | 0.03 | VH1-69 | VK4-1 | 13 | 4 |
| ADI-41502 | 2849 | 1.34E-09 | 3.08E-10 | >25 | Both | 0.01 | VH1-69 | VL2-11 | 12 | 5 |
| ADI-41503 | 2849 | 3.14E-09 | 4.93E-10 | >25 | Both | 0.01 | VH3-23 | VL2-14 | 9 | 3 |
| ADI-41504 | 2849 | 2.80E-09 | 5.08E-10 | >25 | Both | 0.01 | VH4-59 | VL1-40 | 8 | 3 |
| ADI-41505 | 2849 | 2.87E-09 | 5.23E-10 | >25 | Both | 0.00 | VH4-34 | VL1-40 | 11 | 4 |
| ADI-41507 | 2849 | N.B. | 1.40E-07 | >25 | PostF | 0.00 | VH2-5 | VL1-40 | 4 | 5 |
| ADI-41508 | 2849 | 4.15E-09 | 5.55E-10 | 0.10 | Both | 0.00 | VH1-18 | VL3-1 | 13 | 6 |
| ADI-41515 | 2849 | 3.33E-10 | N.B. | >25 | preF | 0.00 | VH3-23 | VL3-10 | 13 | 7 |
| ADI-41516 | 2849 | 4.14E-10 | N.B. | 0.08 | preF | 0.00 | VH4-4 | VL1-47 | 16 | 7 |
| ADI-41517 | 2849 | 5.01E-10 | N.B. | 0.02 | preF | 0.00 | VH3-23 | VL1-40 | 10 | 4 |
| ADI-41518 | 2849 | 7.76E-10 | N.B. | >25 | preF | 0.00 | VH3-21 | VL1-40 | 2 | 0 |
| ADI-41519 | 2849 | 9.75E-10 | N.B. | >25 | preF | 0.00 | VH4-39 | VK3-20 | 15 | 2 |
| ADI-41520 | 2849 | 9.98E-10 | N.B. | >25 | preF | 0.00 | VH3-20 | VK1-39 | 6 | 8 |
| ADI-41521 | 2849 | 1.68E-09 | N.B. | >25 | preF | 0.00 | VH3-9 | VK3-20 | 9 | 11 |
| ADI-41522 | 2849 | 2.20E-09 | N.B. | >25 | preF | 0.00 | VH1-69 | VL2-14 | 10 | 5 |
| ADI-41523 | 2849 | 2.91E-09 | N.B. | >25 | preF | 0.00 | VH5-51 | VK1-39 | 6 | 2 |
| ADI-41524 | 2849 | 3.18E-09 | N.B. | >25 | preF | 0.00 | VH3-49 | VK2-28 | 6 | 3 |
| ADI-41525 | 2849 | N.B. | 3.27E-10 | >25 | PostF | 0.00 | VH1-69 | VL2-14 | 19 | 4 |
| ADI-41526 | 2849 | 3.01E-10 | 3.36E-10 | >25 | Both | 0.00 | VH1-2 | VL1-44 | 8 | 6 |
| ADI-41527 | 2849 | 7.12E-10 | 3.37E-10 | >25 | Both | 0.00 | VH3-7 | VK1-12 | 4 | 6 |
| ADI-41528 | 2849 | 2.28E-10 | 3.48E-10 | >25 | Both | 0.00 | VH3-30 | VL3-1 | 5 | 8 |
| ADI-41529 | 2849 | 1.03E-09 | 3.51E-10 | >25 | Both | 0.00 | VH1-69 | VK3-20 | 19 | 7 |
| ADI-41530 | 2849 | 1.91E-09 | 3.55E-10 | >25 | Both | 0.00 | VH1-8 | VL3-9 | 10 | 8 |
| ADI-41531 | 2849 | 2.08E-09 | 3.77E-10 | >25 | Both | 0.00 | VH3-23 | VK1-33 | 12 | 11 |
| ADI-41532 | 2849 | 1.92E-09 | 3.92E-10 | >25 | Both | 0.00 | VH5-51 | VL1-44 | 5 | 3 |
| ADI-41533 | 2849 | 1.47E-09 | 4.23E-10 | >25 | Both | 0.00 | VH3-30 | VL3-1 | 10 | 9 |
| ADI-41534 | 2849 | 3.31E-09 | 4.72E-10 | >25 | Both | 0.00 | VH3-30 | VL3-1 | 8 | 3 |
| ADI-41535 | 2849 | 1.93E-09 | 4.76E-10 | >25 | Both | 0.00 | VH2-70D | VK1-39 | 5 | 6 |
| ADI-41536 | 2849 | 3.05E-09 | 4.76E-10 | >25 | Both | 0.00 | VH4-34 | VL1-40 | 10 | 3 |
| ADI-41537 | 2849 | 2.58E-09 | 4.88E-10 | >25 | Both | 0.00 | VH3-23 | VK2-28 | 7 | 2 |
| ADI-41538 | 2849 | 3.44E-09 | 5.87E-10 | >25 | Both | 0.00 | VH3-21 | VK4-1 | 12 | 4 |
| ADI-41538 | 2849 | 3.44E-09 | 5.87E-10 | >25 | Both | 0.00 | VH3-21 | VK4-1 | 12 | 4 |
| ADI-41539 | 2849 | 3.38E-09 | 6.15E-10 | 0.18 | Both | 0.00 | VH1-18 | VK3-15 | 6 | 3 |
| ADI-41540 | 2849 | 3.54E-09 | 6.86E-10 | >25 | Both | 0.00 | VH4-34 | VK3-20 | 17 | 9 |
| ADI-41541 | 2849 | 2.47E-09 | 7.76E-10 | >25 | Both | 0.00 | VH2-5 | VL3-21 | 1 | 2 |
| ADI-41542 | 2849 | N.B. | 7.96E-10 | 0.69 | PostF | 0.00 | VH5-51 | VK1-33 | 9 | 9 |
| ADI-41543 | 2849 | 2.90E-09 | 7.96E-10 | >25 | Both | 0.00 | VH1-2 | VK2-28 | 16 | 4 |
| ADI-41544 | 2849 | N.B. | 8.05E-10 | >25 | PostF | 0.00 | VH5-51 | VK1-33 | 6 | 3 |
| ADI-41545 | 2849 | 1.36E-09 | 8.25E-10 | >25 | Both | 0.00 | VH4-59 | VL3-21 | 7 | 2 |
| ADI-41546 | 2849 | N.B. | 1.08E-09 | >25 | PostF | 0.00 | VH5-51 | VK1-9 | 4 | 1 |
| ADI-41547 | 2849 | 3.19E-09 | 1.08E-09 | 0.05 | Both | 0.00 | VH1-69 | VK3-20 | 11 | 7 |
| ADI-41548 | 2849 | 2.56E-09 | 1.45E-09 | >25 | Both | 0.00 | VH4-4 | VK3-15 | 13 | 5 |
| ADI-41549 | 2849 | 4.08E-10 | 1.56E-09 | >25 | Both | 0.00 | VH3-30 | VL2-14 | 5 | 2 |
| ADI-41550 | 2849 | 2.29E-10 | 2.57E-08 | >25 | Both | 0.00 | VH1-18 | VL3-21 | 10 | 2 |
| ADI-41551 | 2849 | 1.30E-08 | 2.38E-08 | >25 | Both | 0.00 | VH3-74 | VL3-1 | 8 | 8 |
| ADI-43643 | 2666 | 7.66E-08 | N.B. | >25 | preF | 0.10 | VH3-21 | VL1-40 | 0 | 0 |
| ADI-43644 | 2665 | 2.93206E-08 | N.B. | >25 | preF | 0.00 | VH3-23 | VK3-11 | 0 | 0 |
| ADI-43645 | 2666 | 8.70E-09 | N.B. | >25 | preF | 0.25 | VH1-69 | VK1-5 | 0 | 0 |
| ADI-43646 | 2635 | 5.34462E-08 | N.B. | >25 | preF | 0 | VH3-43D | VL2-14 | 0 | 1 |
| ADI-43647 | 2635 | N.B. | 4.4563E-08 | >25 | PostF | 0 | VH3-23 | VK1-12 | 3 | 0 |
| ADI-43648 | 2666 | N.B. | 2.86E-08 | >25 | PostF | 0.10 | VH1-8 | VL3-9 | 0 | 1 |

TABLE 7

Summary of antibody characteristics for antibodies isolated from PBMCs

| Name | Donor | RSV preF binding KD | RSV postF binding KD | Neutralization IC50 (RSV subtype A) | Specificiity | PSR score | VH Germline | VL Germline | VH Protein Muts | VL Protein Muts |
|---|---|---|---|---|---|---|---|---|---|---|
| ADI-36673 | 2635 | 6.20328E-10 | N.B. | 0.019954073 | preF | 0.00 | VH3-11 | VL1-40 | 7 | 5 |
| ADI-36675 | 2635 | 8.07354E-10 | N.B. | 0.006 | preF | 0.00 | VH3-23 | VL1-51 | 10 | 11 |
| ADI-36676 | 2635 | 2.82227E-10 | N.B. | 0.006 | preF | 0.00 | VH3-30 | VL3-21 | 10 | 5 |
| ADI-36678 | 2635 | 7.16249E-10 | N.B. | 0.006 | preF | 0.14 | VH3-66 | VL3-1 | 14 | 15 |
| ADI-41552 | 2635 | 3.44465E-09 | 5.21877E-10 | >25 | Both | 0.39 | VH3-48 | VK3-11 | 10 | 4 |

TABLE 7-continued

Summary of antibody characteristics for antibodies isolated from PBMCs

| Name | Donor | RSV preF binding KD | RSV postF binding KD | Neutralization IC50 (RSV subtype A) | Specificity | PSR score | VH Germline | VL Germline | VH Protein Muts | VL Protein Muts |
|---|---|---|---|---|---|---|---|---|---|---|
| ADI-41553 | 2635 | N.B. | 8.03693E−10 | >25 | postF | 0.22 | VH1-18 | VK1-5 | 7 | 1 |
| ADI-41554 | 2635 | 1.34614E−09 | 1.07074E−09 | >25 | Both | 0.21 | VH3-23 | VK1-5 | 8 | 7 |
| ADI-41555 | 2635 | 5.68885E−09 | 1.12393E−09 | 25 | Both | 0.20 | VH4-31 | VK3-11 | 8 | 7 |
| ADI-41556 | 2635 | N.B. | 2.27656E−09 | >25 | postF | 0.19 | VH3-21 | VK3-15 | 5 | 3 |
| ADI-41557 | 2635 | 3.08525E−08 | 8.61139E−08 | >25 | Both | 0.17 | VH4-59 | VK3-15 | 11 | 8 |
| ADI-41558 | 2635 | 3.01911E−09 | 7.00004E−10 | >25 | Both | 0.17 | VH3-11 | VK3-20 | 14 | 5 |
| ADI-41561 | 2635 | 3.32537E−09 | 5.15754E−10 | >25 | Both | 0.14 | VH2-5 | VK1-12 | 10 | 8 |
| ADI-41562 | 2635 | N.B. | 6.75971E−10 | >25 | postF | 0.12 | VH1-18 | VK3-15 | 20 | 6 |
| ADI-41563 | 2635 | 6.02208E−10 | N.B. | 0.032327297 | preF | 0.12 | VH4-59 | VL1-40 | 11 | 11 |
| ADI-41564 | 2635 | 4.43977E−09 | 5.95709E−10 | >25 | Both | 0.12 | VH1-69 | VK3-20 | 20 | 0 |
| ADI-41567 | 2635 | 7.16511E−10 | N.B. | 0.050532702 | preF | 0.11 | VH4-34 | VK1-9 | 12 | 4 |
| ADI-41568 | 2635 | N.B. | 2.0658E−09 | >25 | postF | 0.09 | VH4-34 | VL3-25 | 7 | 4 |
| ADI-41569 | 2635 | 3.29786E−09 | 1.60525E−09 | >25 | Both | 0.08 | VH1-69 | VK3D-15 | 10 | 7 |
| ADI-41570 | 2635 | 2.97345E−09 | 1.1235E−09 | 25 | Both | 0.08 | VH1-69 | VL1-51 | 11 | 6 |
| ADI-41571 | 2635 | 6.27081E−10 | N.B. | 0.031530527 | preF | 0.07 | VH3-11 | VL1-40 | 14 | 10 |
| ADI-41574 | 2635 | N.B. | 1.23235E−07 | >25 | postF | 0.02 | VH2-5 | VK1-5 | 1 | 7 |
| ADI-41576 | 2635 | N.B. | 1.42548E−09 | >25 | postF | 0.01 | VH2-5 | VK3-11 | 9 | 10 |
| ADI-41578 | 2635 | 2.48656E−10 | N.B. | 0.039833521 | preF | 0.00 | VH3-30 | VL3-21 | 11 | 12 |
| ADI-41579 | 2635 | 4.71437E−10 | 3.59718E−10 | 0.208709151 | Both | 0.00 | VH1-69 | VL2-14 | 15 | 13 |
| ADI-41580 | 2635 | 2.98246E−09 | 1.17422E−09 | 1.107269577 | Both | 0.00 | VH4-34 | VK4-1 | 10 | 10 |
| ADI-41581 | 2635 | 2.7729E−09 | 3.60691E−10 | >25 | Both | 0.00 | VH7-4-1 | VK2-28 | 10 | 4 |
| ADI-41582 | 2635 | N.B. | 9.11488E−10 | >25 | postF | 0.00 | VH4-31 | VL3-21 | 6 | 8 |
| ADI-41583 | 2635 | 6.63714E−10 | 3.80536E−10 | >25 | Both | 0.00 | VH1-69 | VK1-33 | 10 | 1 |
| ADI-41584 | 2635 | 3.08613E−09 | N.B. | >25 | preF | 0.00 | VH1-2 | VL1-40 | 10 | 5 |
| ADI-41585 | 2635 | 6.13E−10 | N.B. | 0.064052351 | preF | 0.00 | VH3-11 | VL1-40 | 6 | 3 |
| ADI-41586 | 2635 | 5.37539E−10 | 7.79176E−10 | 0.401663761 | Both | 0.00 | VH4-34 | VK2-28 | 9 | 3 |
| ADI-41587 | 2635 | 1.4048E−09 | 2.08899E−09 | 0.663851609 | Both | 0.00 | VH4-34 | VK2-28 | 8 | 5 |
| ADI-41588 | 2635 | 3.32826E−09 | 5.04922E−10 | >25 | Both | 0.00 | VH2-5 | VL3-1 | 5 | 2 |
| ADI-41589 | 2635 | 4.20258E−09 | N.B. | >25 | preF | 0.00 | VH3-23 | VK4-1 | 8 | 8 |
| ADI-41590 | 2635 | 3.0202E−09 | N.B. | >25 | preF | 0.00 | VH3-11 | VK1-39 | 7 | 10 |
| ADI-41591 | 2635 | 4.25861E−09 | N.B. | >25 | preF | 0.00 | VH3-11 | VL1-40 | 0 | 2 |
| ADI-41592 | 2635 | 3.73679E−09 | 4.40201E−10 | >25 | Both | 0.00 | VH7-4-1 | VL3-1 | 5 | 13 |
| ADI-41593 | 2635 | 1.8323E−09 | 5.29992E−10 | >25 | Both | 0.00 | VH5-51 | VK1-8 | 4 | 2 |
| ADI-41594 | 2635 | 4.13628E−10 | N.B. | 0.040569222 | preF | 0.00 | VH3-21 | VL1-40 | 10 | 4 |
| ADI-41595 | 2635 | 7.70076E−10 | N.B. | 0.047476327 | preF | 0.00 | VH3-30 | VK1-33 | 9 | 11 |
| ADI-41596 | 2635 | 3.04558E−10 | 4.37255E−10 | 0.053741113 | Both | 0.00 | VH4-34 | VK4-1 | 6 | 2 |
| ADI-41597 | 2635 | 3.56836E−10 | N.B. | 0.172508371 | preF | 0.00 | VH4-61 | VL3-21 | 6 | 3 |
| ADI-41598 | 2635 | 4.94657E−10 | N.B. | 0.174094146 | preF | 0.00 | VH4-59 | VK1-39 | 11 | 11 |
| ADI-41599 | 2635 | 7.90767E−10 | 4.32706E−10 | 0.636806381 | Both | 0.00 | VH3-48 | VK1-39 | 16 | 13 |
| ADI-41600 | 2635 | 4.93359E−09 | 7.54853E−10 | >25 | Both | 0.00 | VH3-30 | VK1D-12 | 15 | 9 |
| ADI-41601 | 2635 | 5.02595E−10 | N.B. | >25 | preF | 0.00 | VH3-11 | VL1-40 | 11 | 10 |
| ADI-41602 | 2635 | 2.85465E−09 | 4.54781E−10 | >25 | Both | 0.00 | VH4-59 | VL2-14 | 7 | 10 |
| ADI-41603 | 2635 | 3.49281E−09 | 4.89905E−10 | >25 | Both | 0.00 | VH3-49 | VK3-15 | 10 | 6 |
| ADI-41604 | 2635 | 1.7801E−08 | 2.92494E−08 | >25 | Both | 0.00 | VH1-2 | VK1-33 | 1 | 0 |
| ADI-41605 | 2635 | 3.18275E−09 | 5.5033E−10 | >25 | Both | 0.00 | VH4-31 | VK4-1 | 8 | 9 |
| ADI-41606 | 2635 | 3.38754E−09 | 1.02586E−09 | >25 | Both | 0.00 | VH4-61 | VK1D-12 | 9 | 7 |
| ADI-41607 | 2635 | 4.24282E−09 | 7.09182E−10 | >25 | Both | 0.00 | VH4-31 | VL2-11 | 7 | 11 |
| ADI-41608 | 2635 | 1.93484E−09 | 2.85427E−10 | >25 | Both | 0.00 | VH5-51 | VL6-57 | 15 | 3 |
| ADI-41609 | 2635 | 2.90676E−08 | N.B. | >25 | preF | 0.00 | VH1-46 | VL1-40 | 14 | 10 |
| ADI-41610 | 2635 | N.B. | 9.78084E−10 | >25 | postF | 0.00 | VH3-30 | VK1-39 | 12 | 1 |
| ADI-41611 | 2635 | 3.08502E−09 | 6.11386E−10 | >25 | Both | 0.00 | VH3-21 | VK1-39 | 6 | 6 |
| ADI-41626 | 2665 | 2.60E−09 | 8.91E−10 | >25 | Both | 0.17 | VH4-4 | VK1-39 | 9 | 9 |
| ADI-41644 | 2665 | 3.03E−09 | 1.10E−09 | >25 | Both | 0.11 | VH4-34 | VK3D-15 | 13 | 14 |
| ADI-41660 | 2665 | 2.94E−09 | 9.55E−10 | >25 | Both | 0.10 | VH1-69 | VL1-51 | 5 | 1 |
| ADI-41662 | 2665 | 5.24E−09 | 1.21E−09 | >25 | Both | 0.10 | VH5-51 | VL3-10 | 14 | 6 |
| ADI-41664 | 2665 | 2.94E−09 | 8.25E−10 | >25 | Both | 0.10 | VH1-18 | VL3-21 | 11 | 5 |
| ADI-41677 | 2665 | 1.28E−09 | 3.39E−10 | >25 | Both | 0.08 | VH2-70 | VK1-39 | 5 | 12 |
| ADI-41678 | 2665 | 2.92E−09 | 1.17E−09 | >25 | Both | 0.08 | VH3-30 | VL2-8 | 5 | 0 |
| ADI-41690 | 2665 | N.B. | 8.78E−09 | >25 | postF | 0.03 | VH5-51 | VK1-33 | 8 | 5 |
| ADI-41701 | 2665 | 1.93E−09 | 2.89E−10 | >25 | Both | 0.01 | VH5-51 | VL6-57 | 6 | 9 |
| ADI-41703 | 2665 | 4.20E−09 | 8.43E−10 | >25 | Both | 0.00 | VH4-30-2 | VK3-20 | 6 | 5 |
| ADI-41720 | 2665 | 2.20E−08 | 1.17E−09 | >25 | Both | 0.00 | VH3-33 | VK1-5 | 5 | 2 |
| ADI-41737 | 2665 | 3.58E−09 | 1.58E−09 | >25 | Both | 0.00 | VH4-30-4 | VK3-20 | 9 | 8 |
| ADI-41743 | 2665 | 5.45E−09 | 1.27E−09 | >25 | Both | 0.00 | VH4-30-2 | VK3-15 | 14 | 4 |
| ADI-41756 | 2665 | 2.90E−08 | N.B. | >25 | preF | 0.00 | VH3-30 | VL2-14 | 8 | 20 |
| ADI-41768 | 2666 | 1.61459E−09 | 3.38298E−10 | >25 | Both | 0.10 | VH3-9 | VL6-57 | 6 | 6 |
| ADI-41772 | 2666 | 7.10105E−10 | N.B. | 0.04 | preF | 0.10 | VH3-11 | VL3-10 | 12 | 7 |
| ADI-41778 | 2666 | 2.75256E−09 | 5.04199E−10 | >25 | Both | 0.10 | VH3-9 | VL2-11 | 5 | 4 |
| ADI-41781 | 2666 | 3.46456E−09 | 6.53361E−10 | >25 | Both | 0.07 | VH1-18 | VK1-27 | 16 | 4 |
| ADI-41783 | 2666 | 5.42456E−10 | N.B. | 0.25 | preF | 0.10 | VH1-18 | VK2-30 | 7 | 0 |
| ADI-41787 | 2666 | 1.56237E−09 | N.B. | 0.38 | preF | 0.10 | VH3-30 | VL3-10 | 7 | 6 |
| ADI-41788 | 2666 | 2.755E−10 | N.B. | 0.47 | preF | 0.10 | VH1-8 | VL3-21 | 8 | 1 |
| ADI-41790 | 2666 | 3.15261E−09 | N.B. | >25 | preF | 0.10 | VH1-69 | VK3-11 | 7 | 6 |
| ADI-41792 | 2666 | 2.98373E−08 | N.B. | >25 | preF | 0.10 | VH3-21 | VL1-40 | 2 | 1 |

TABLE 7-continued

Summary of antibody characteristics for antibodies isolated from PBMCs

| Name | Donor | RSV preF binding KD | RSV postF binding KD | Neutralization IC50 (RSV subtype A) | Specificity | PSR score | VH Germline | VL Germline | VH Protein Muts | VL Protein Muts |
|---|---|---|---|---|---|---|---|---|---|---|
| ADI-41794 | 2666 | 3.30922E−09 | 3.01006E−09 | >25 | Both | 0.10 | VH4-34 | VL1-51 | 0 | 3 |
| ADI-41799 | 2666 | 3.27629E−09 | 1.10141E−09 | >25 | Both | 0.14 | VH1-69 | VK1-5 | 17 | 5 |
| ADI-41800 | 2849 | 3.24E−09 | N.B. | >25 | preF | 0.40 | VH1-2 | VL2-14 | 10 | 5 |
| ADI-41803 | 2849 | 1.99E−09 | 7.11E−10 | >25 | Both | 0.17 | VH4-34 | VK1-17 | 16 | 6 |
| ADI-41804 | 2849 | 3.31E−10 | 4.36E−10 | >25 | Both | 0.15 | VH4-34 | VK1-27 | 11 | 5 |
| ADI-41805 | 2849 | N.B. | 2.00E−09 | >25 | postF | 0.14 | VH5-51 | VL2-14 | 4 | 7 |
| ADI-41807 | 2849 | 1.50E−09 | 1.19E−09 | >25 | Both | 0.14 | VH2-70 | VK1-39 | 6 | 10 |
| ADI-41808 | 2849 | 1.39E−08 | 2.25E−08 | >25 | Both | 0.14 | VH1-69 | VK1-5 | 21 | 7 |
| ADI-41809 | 2849 | 2.65E−09 | N.B. | >25 | preF | 0.12 | VH3-23 | VL1-47 | 9 | 5 |
| ADI-41810 | 2849 | 2.03E−09 | N.B. | >25 | preF | 0.11 | VH3-30 | VK3-15 | 7 | 8 |
| ADI-41811 | 2849 | 1.64E−09 | 7.44E−10 | >25 | Both | 0.11 | VH6-1 | VK3-11 | 10 | 7 |
| ADI-41812 | 2849 | 3.14E−10 | N.B. | 0.17 | preF | 0.11 | VH3-21 | VL1-40 | 6 | 1 |
| ADI-41814 | 2849 | 3.39E−09 | 9.15E−10 | >25 | Both | 0.10 | VH2-5 | VL1-40 | 3 | 13 |
| ADI-41815 | 2849 | 3.21E−09 | N.B. | >25 | preF | 0.10 | VH3-21 | VK2-28 | 9 | 0 |
| ADI-41816 | 2849 | 6.56E−10 | N.B. | 0.91 | preF | 0.10 | VH1-2 | VL3-1 | 8 | 2 |
| ADI-41817 | 2849 | 6.94E−09 | 1.58E−08 | >25 | Both | 0.09 | VH5-51 | VL2-14 | 7 | 9 |
| ADI-41818 | 2849 | 6.76E−10 | 3.47E−10 | >25 | Both | 0.03 | VH3-66 | VK3-20 | 8 | 2 |
| ADI-41820 | 2849 | 6.49E−08 | N.B. | >25 | preF | 0.01 | VH3-30 | VL7-46 | 11 | 4 |
| ADI-41827 | 2849 | 1.86E−09 | N.B. | >25 | preF | 0.00 | VH3-30 | VL3-1 | 10 | 7 |
| ADI-41828 | 2849 | 2.41E−10 | N.B. | 5.53 | preF | 0.00 | VH3-48 | VL3-21 | 9 | 0 |
| ADI-41829 | 2849 | 2.71E−10 | N.B. | 0.12 | preF | 0.00 | VH3-21 | VL1-40 | 5 | 2 |
| ADI-41830 | 2849 | 2.90E−10 | N.B. | 0.12 | preF | 0.00 | VH1-18 | VK2-28 | 13 | 0 |
| ADI-41831 | 2849 | 3.29E−10 | N.B. | 5.21 | preF | 0.00 | VH3-21 | VL1-40 | 8 | 3 |
| ADI-41832 | 2849 | 6.31E−10 | N.B. | 0.19 | preF | 0.00 | VH3-23 | VK3-20 | 8 | 4 |
| ADI-41833 | 2849 | 7.23E−10 | N.B. | 0.02 | preF | 0.00 | VH3-23 | VK1-27 | 7 | 6 |
| ADI-41834 | 2849 | 1.20E−09 | N.B. | 0.07 | preF | 0.00 | VH3-66 | VK1-33 | 9 | 5 |
| ADI-41835 | 2849 | 1.43E−09 | N.B. | 0.45 | preF | 0.00 | VH3-23 | VL3-1 | 3 | 4 |
| ADI-41836 | 2849 | 5.74E−09 | N.B. | >25 | preF | 0.00 | VH1-3 | VL1-40 | 9 | 8 |
| ADI-41837 | 2849 | 7.09E−09 | N.B. | >25 | preF | 0.00 | VH1-18 | VK2-30 | 4 | 3 |
| ADI-41838 | 2849 | 3.21E−08 | N.B. | >25 | preF | 0.00 | VH3-30 | VL2-14 | 8 | 3 |
| ADI-41839 | 2849 | 7.88E−09 | N.B. | >25 | preF | 0.00 | VH3-30 | VL3-21 | 14 | 2 |
| ADI-41840 | 2849 | 3.33E−09 | N.B. | >25 | preF | 0.00 | VH1-69 | VK3-15 | 17 | 3 |
| ADI-41841 | 2849 | 1.21E−10 | 2.65E−10 | 0.04 | Both | 0.00 | VH3-21 | VK1-33 | 6 | 8 |
| ADI-41842 | 2849 | 7.17E−10 | 4.42E−10 | >25 | Both | 0.00 | VH1-8 | VK1-39 | 14 | 6 |
| ADI-43638 | 2665 | N.B. | 9.93404E−09 | >25 | postF | 0.16 | VH4-34 | VK4-1 | 0 | 0 |
| ADI-43639 | 2635 | N.B. | 2.32551E−07 | >25 | postF | 0.00 | VH7-4-1 | VK1-39 | 0 | 0 |
| ADI-43640 | 2665 | 2.15586E−08 | N.B. | >25 | preF | 0.08 | VH3-21 | VL1-40 | 0 | 0 |
| ADI-43641 | 2665 | 3.74656E−08 | N.B. | >25 | preF | 0.09 | VH3-11 | VL1-40 | 0 | 0 |
| ADI-43642 | 2635 | 4.31745E−08 | N.B. | >25 | preF | 0.00 | VH3-21 | VL1-40 | 0 | 0 |

Adenoid- and PBMC-Derived Antibodies Show Similar Levels of Polyreactivity

Figure 20A:
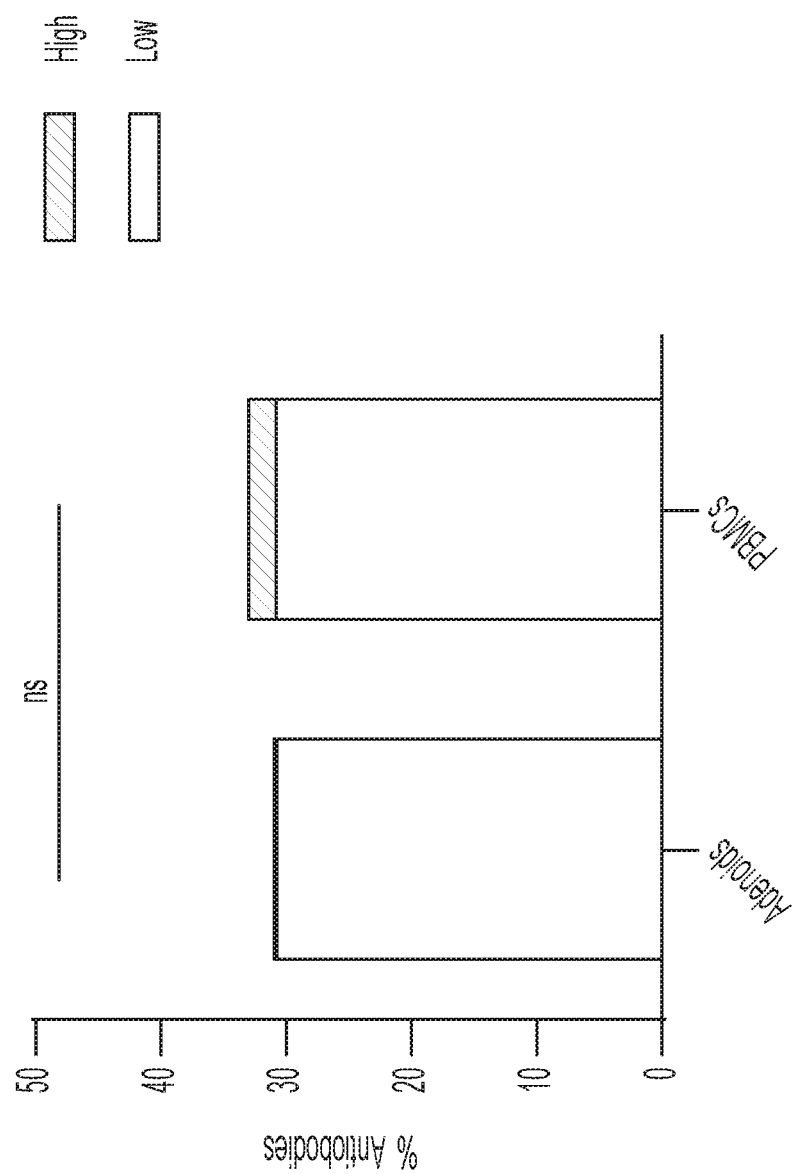
FIGS. 20A-C shows the levels of polyreactivity and binding affinities of the antibodies derived from the adenoid and PBMC samples.
Figure 20B:
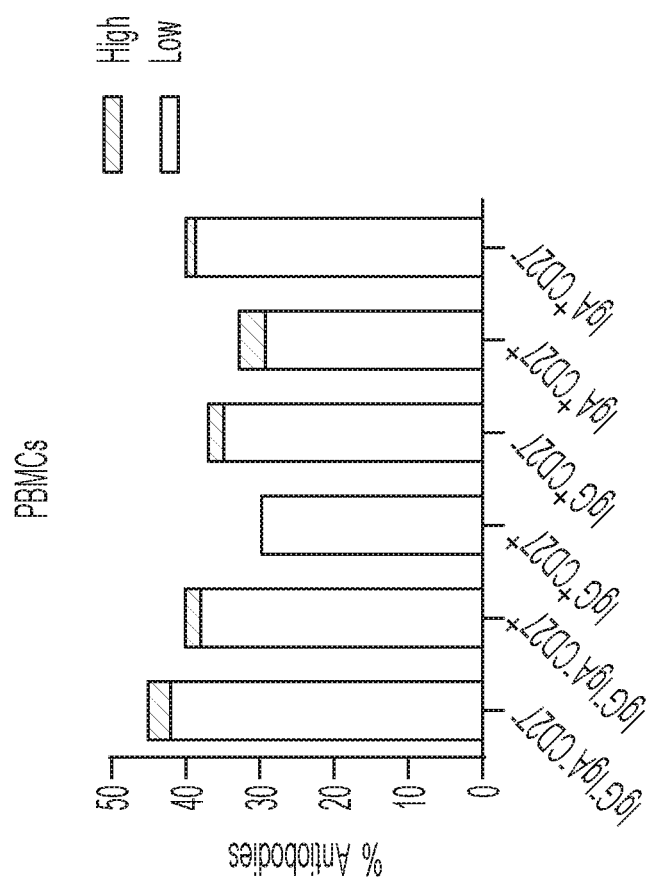
Figure 20B:
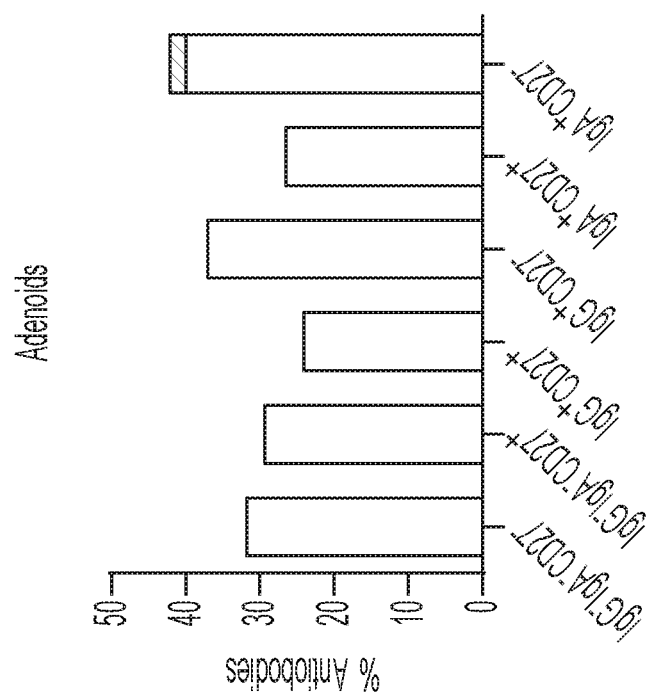
Figure 20C:
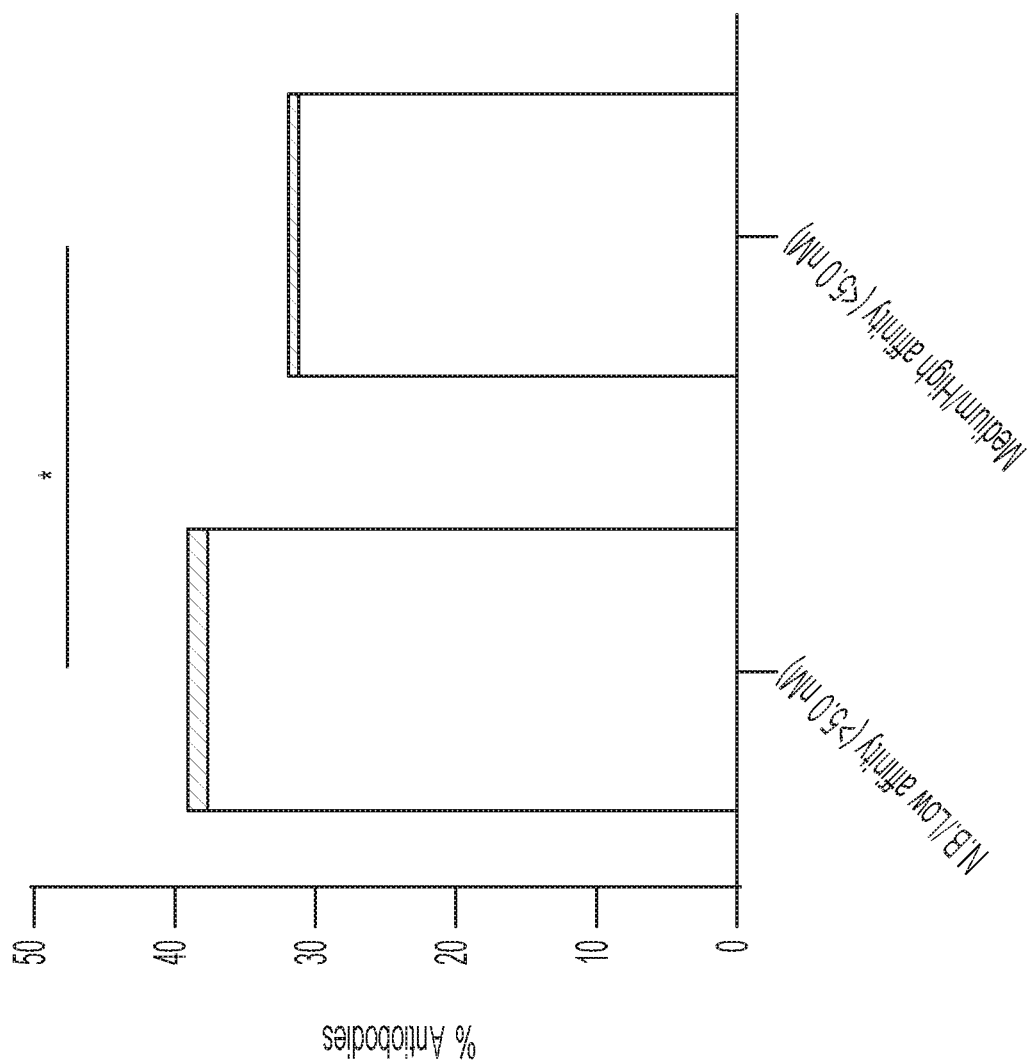

The specificity of each antibody was assessed using a previously described polyreactivity assay. In healthy adult donors, a relatively large proportion of memory B cell-derived antibodies have been shown to be polyreactive (Tiller, 2007). Consistent with these findings, approximately 35% of antibodies derived from both the adenoid and PBMC samples showed low levels of polyreactivity (FIG. 20A). The percentage of polyreactive clones was relatively similar across the different B cell subsets within each compartment, although the PBMC-derived IgG−IgA−CD27− B cell population showed a slighter higher proportion of polyreactive clones compared to many of the other B cell subsets (FIG. 20B). A slight enrichment for polyreactive clones was observed among the group of antibodies that bound with weak affinity to RSV F (FIG. 20C). In conclusion, the mucosal and systemic B cell compartments contain a similar proportion of polyreactive clones, with about a third of RSV F-specific B cells in both compartments showing some degree of polyreactivity.

Discussion

A detailed understanding of mucosal and systemic immune responses to natural RSV infection can facilitate the design and evaluation of RSV vaccine candidates. Although previous studies have shown that mucosal antibody responses are important for protection against RSV in both humans and animal models, the specificities and functional activities of these antibodies have remained undefined. Furthermore, the anatomic location(s) and characteristics of RSV-specific memory B cells within mucosa-associated lymphoid tissues have not been thoroughly investigated. By collecting paired adenoid and blood samples from six young children undergoing elective tonsillectomy and using a high-throughput B cell cloning platform, the local and systemic B cell responses to natural RSV infection were analyzed and compared.

RSV F-specific B cell responses were observed in the adenoids of all 6 donors analyzed, whereas such responses were only detected in the peripheral blood samples of 4 of the 6 donors. In addition, in most donors studied, a higher proportion of adenoid-derived antibodies displayed high affinity binding and potent neutralizing activity compared to PBMC-derived antibodies. These results provide evidence that RSV-specific memory B cells are induced and maintained within adenoid tissue and suggest that this local response may be more robust and/or durable than the corresponding systemic response. Hence, adenoidectomy may result in a reduction of local immune competence against RSV, as previously demonstrated by diminished poliovirus-specific antibody levels in nasal secretions from children following tonsillectomy and adenoidectomy (Ogra P. L. (1971) Effect of tonsillectomy and adenoidectomy on nasopharyngeal antibody response to poliovirus. N. Engl. J. Med. 284:59-6).

The adenoids of all donors studied contained a high frequency of RSV F-specific memory B cells that displayed mutated v-regions but were not isotype-switched and lacked expression of the classical memory B cell marker CD27. Although RSV F-specific B cells that displayed this surface phenotype were also present in peripheral blood, the frequency was significantly lower than that observed in adenoid tissue and the majority of these B cells encoded antibodies that lacked somatic mutations. Unlike the tissue-based IgG$^+$ CD27$^-$ FCRL4$^+$ memory B cell population that has been previously described in human tonsils, the RSV F-specific IgG$^-$IgA$^-$CD27$^-$ B cells observed in the adenoids of these donors did not express FCRL4 or IgG and were highly heterogeneous with respect to IgM and IgD expression. Previous studies have also described atypical memory B cells in peripheral blood that are isotyped-switched, lack CD27 expression, and display lower levels of SHM compared to their CD27$^+$ counterparts. In contrast to this population, the atypical adenoid-derived memory B cell subset described here shows similar levels of SHM compared to classical IgG$^+$ CD27$^+$ memory B cells, suggesting similar antigenic selection characteristics. A single clonal lineage present in both adenoid and peripheral blood of one donor was identified, and the PBMC-derived clone originated from an IgG$^+$CD27$^-$ B cell whereas the adenoid-derived clone originated from an IgG$^-$IgA$^-$CD27$^-$ B cell, suggesting a possible relationship between these two atypical B cell subsets. RSV F-specific IgA$^+$ memory B cells were detected in both adenoid and peripheral blood for all donors.

Previous studies have shown that RSV antibodies that bind preF-specific surfaces are generally more potent than those that recognize epitopes expressed on both pre- and post-F or only on postF. Correspondingly, in the 4 young children analyzed here, over 90% of the neutralizing antibodies isolated from both adenoid and peripheral blood recognized epitopes exclusively expressed on preF. The high abundance of preF-specific neutralizing antibodies and near absence of postF-reactive neutralizing antibodies in adenoid tissue suggests that mucosal vaccines the preserve preF-specific antigenic surfaces may induce higher titers of protective antibodies than postF-based vaccines. Although the majority of mucosal vaccines are particle- or vector-based, it has been shown that preF can spontaneously trigger to adopt postF conformation on the viral surface, underscoring the importance of carefully evaluating the antigenic properties of such vaccine candidates. The extensive panel of antibodies described here could be used as reagents to measure the prefusion and postfusion F content of these vaccines.

Collectively, this demonstrates that 1) adenoids can serve as a major induction site for RSV-specific memory B cell responses and that a large proportion of this response is comprised of atypical IgM+ and/or IgD+ memory B cells; 2) the vast majority of adenoid-derived neutralizing antibodies target epitopes exclusively expressed on preF, which supports the development of preF-based mucosal vaccines that boost local responses.

Methods

Sample Collection

Heparinized blood and tonsillar tissue were collected from the patient after a planned therapeutic tonsillectomy for clinical indications (parental consent obtained during a pre-operative visit in accordance with approved IRB). Tonsillar tissue consisted of tonsils (palatine tonsils) and adenoids (pharyngeal tonsils), which together make up Waldeyer's ring.

After collection, tonsillar tissue was mechanically disrupted, e.g., grinding of tissue between the fritted glass at the end of microscope slides or by proteolytic digestion of the tissue typically with pronase, and mucosal lymphoid populations were isolated by standard methods, e.g., ficoll gradient. Several methods exist to recover secreted immunoglobulins from the mucosal surface of the tissue, e.g., Pope earwick or ex vivo culture systems. Peripheral blood was separated to recover plasma and then further fractionated to recover lymphoid cells.

Isolated lymphoid cells from paired tonsillar tissue and blood were used to identify and characterize monoclonal antibodies from single B cells.

Production of RSV F Sorting Probes

PreF (DS-Cav1) and postF (F ΔFP) trimers were produced with a single biotinylated C-terminal AviTag and then coupled to streptavidin-PE or APC, as described previously (Gilman et al, Sci Immunol 2016). Expression vectors containing a C-terminal 6x His-tag-AviTag or a C-terminal Strep-tag II were co-transfected into FreeStyle 293-F cells at a 1:2 ratio for each variant. The protein was purified from the cell supernatant using Ni-nitrilotriacetic acid (NTA) resin to remove trimers lacking the 6x His-tag-AviTag, then purified over StrepTactin resin. The resin was washed to remove trimers containing only one StrepTagII, and the remaining proteins were then biotinylated using birA (Avidity). The biotinylated proteins were separated from excess biotin by size-exclusion chromatography using a Superdex 200 column (GE Healthcare) in PBS.

Single B Cell Sorting

PBMCs and adenoids from young children were stained using anti-human CD19 (APC-Cy7), CD20 (APC-Cy7), CD3 (PerCP-Cy5.5), CD8 (PerCP-Cy5.5), CD14 (PerCP-Cy5.5), CD16 (PerCP-Cy5.5), FcRL4 (PECy7), IgG (BV605), IgA (488), CD27 (BV421), and a mixture of dual-labeled preF and postF tetramers (25 nM each). To determine the percentage of RSV-F specific B cells expressing IgM or IgD, the adenoid samples were stained using human CD19 (APC-Cy7), CD20 (APC-Cy7), CD3 (PerCP-Cy5.5), CD8 (PerCP-Cy5.5), CD14 (PerCP-Cy5.5), CD16 (PerCP-Cy5.5), IgM (PECy7), IgD (BV510), IgG (BV605), IgA (488), CD27 (BV421), and a mixture of dual-labeled preF and postF tetramers (25 nM each). Tetramers were prepared fresh for each experiment, and total B cells binding to the RSV F tetramers were single cell sorted. Single cells were sorted using a BD FACS Aria II (BD Biosciences) into 96-well PCR plates (BioRAD) containing 20 uL/well of lysis buffer [5 uL of 5X first strand cDNA buffer (Invitrogen), 0.625 uL of NP-40 (New England Biolabs), 0.25 uL RNaseOUT (Invitrogen), 1.25 uL dithiothreitol (Invitrogen), and 12.6 uL dH2O]. Plates were immediately stored at −80° C.

Amplification and Cloning of Antibody Variable Genes

Antibody variable genes (IgH, IgK, and IgL) were amplified by reverse transcription PCR and nested PCRs using cocktails of IgG-, IgA-, and IgM-specific primers, as described previously (Tiller et al, J Immunol 2008). The primers used in the second round of PCR contained 40 base pairs of 5' and 3' homology to the digested expression vectors, which allowed for cloning by homologous recombination into *S. cerevisiae*. The lithium acetate method for chemical transformation was used to clone the PCR products into *S. cerevisiae* (Gietz and Schiestl, Nat Protoc 2007). 10 uL of unpurified heavy chain and light chain PCR product and 200 ng of the digested expression vectors were used per transformation reaction. Following transformation, individual yeast colonies were picked for sequencing and characterization.

Expression and Purification of IgGs

IgGs were expressed in S. cerevisiae cultures grown in 24-well plates, as described previously (Bornholdt et al, Science 2016). After 6 days, the cultures were harvested by centrifugation and IgGs were purified by protein A-affinity chromatography. The bound antibodies were eluted with 200 mM acetic acid/50 mM NaCl (pH 3.5) into ⅛th volume 2 M Hepes (pH 8.0), and buffer-exchanged into PBS (pH 7.0).

Biolayer Interferometry Binding Analysis

IgG binding to preF (DS-Cav1) and postF (F ΔFP) was measured by biolayer interferometry (BLI) using a ForteBio Octet HTX instrument (Pall Life Sciences). For high-throughput $K_D$ determination, IgGs were immobilized on anti-human IgG quantitation biosensors (Pall Life Sciences) and exposed to 100 nM antigen in PBS with 0.1% BSA (PBSF) for an association step, followed by a dissociation step in PBSF. Data were analyzed using the ForteBio Data Analysis Software 7. Kd values were calculated for antibodies with BLI responses >0.1 nm, and the data were fit to a 1:1 binding model to calculate association and dissociation rate constants. The $K_D$ values were calculated using the ratio kd/ka.

Polyreactivity Assay

Polyspecificity reagent binding was assessed as previously described (Xu et al, Protein Eng Des Sel 2013). Briefly, soluble membrane protein (SMP) and soluble cytosolic protein (SCP) fractions were prepared from Chinese hamster ovary cells and biotinylated with NHS-LC-Biotin reagent (Pierce, ThermoFisher Cat #21336). 2 million IgG-presenting yeast were transferred to a 96-well assay plate, pelleted to remove supernatant, then the pellets were resuspended in 50 uL of 1:10 diluted stock of biotinylated SCPs and SMPs and incubated on ice for 20 minutes. Cells were washed twice with ice-cold PBSF, and the samples were incubated in 50 uL of secondary labeling mix (Extravadin-R-PE, goat F(ab') 2-anti human kappa-FITC, and propidium iodide) on ice for 20 minutes. The samples were analyzed for polyspecificity reagent binding using a FACSCanto II (BD Biosciences) with HTS sample injector. Flow cytometry data were analyzed for mean fluorescence intensity in the R-PE channel and normalized to three control antibodies exhibiting low, medium, and high MFI values.

Plasma Neutralization Assay

Infant plasma samples were tested for RSV neutralization in microtiter assays using a recombinant RSV expressing Renilla luciferase (rA2-Rluc; a gift from Dr. Michael Teng, University of South Florida [Fuentes S, Crim R L, Beeler J, Teng M N, Golding H, Khurana S. Development of a simple, rapid, sensitive, high-throughput luciferase reporter based microneutralization test for measurement of virus neutralizing antibodies following Respiratory Syncytial Virus vaccination and infection. Vaccine. 2013 Aug. 20; 31(37):3987-94.]). Hep2 cells were added to 96-well plates at a density of 1.8×104 cells per well in 100<1 of MEM with 2% FBS/1X penicillin-streptomycin solution (2% MEM) and allowed to adhere overnight at 37° C. On the day of the assay, plasma samples were serially diluted 2-fold (1:200 to 1:128,000) in 2% MEM containing rA2-Rluc and incubated for 30 min at 37° C. Culture media was aspirated from the Hep2 cells followed by the addition of 100<<per well of the plasma+rA2-Rluc mixture to duplicate wells. Cultures were maintained at 37° C. for 24 hrs and luciferase expression was quantified in cell lysates using the Renilla Luciferase Assay System (E2820, Promega, Madison, Wis.). Relative light units (RLU) were measured on a BioTek Synergy 2 microplate reader. Neutralization is expressed as the reciprocal of the highest plasma dilution to yield a 50% reduction in RLU as compared to control wells with no added plasma.

Adenoid Neutralization Assay

Adenoid tissue collected on the day of surgery was placed in a sterile 10 cm culture dish. A 1.8 cm circular disc of soft absorbent filter paper (Leukosorb #BSP0669, Pall Corporation, Port Washington N. Y.) was applied to the mucosal surface of the tissue. One ml of PBS with added protease inhibitors (Bestatin 0.1 ug/ml; Aprotinin 1 ug/ml; AEBSF 0.5 ug/ml; Leupeptin 5 ug/ml; Millipore Sigma, St. Louis Mo.) was added to directly to the tissue to moisten the disc. The tissue was allowed to stand for 30 min at room temperature. Excess PBS+ PI was then pipeted from the tissue into a 15 ml conical tube. The filter paper disc was collected with sterile forceps and placed into a separate 15 ml tube. An additional 0.5 ml of PBS+PI was added and the tube was centrifuged at 1,900×g rpm for 10 min. Supernatant recovered directly from the tissue and from the filter disc was retained and tested for RSV neutralizing activity. Supernatants were serially diluted 2-fold (1:4 to 1:256) and tested using the rA2-Rluc microtiter assay. Data is expressed as the dilution corresponding to a 50% inhibitory concentration ($IC_{50}$) compared to control wells with rA2-Rluc alone.

Example 3. Cluster Analysis of Neutralizing Antibodies According to Biophysical Characteristics A set of RSV neutralizing antibodies were analysed for sequences of CDRH3 based on biophysical characteristics using a reduced alphabet scheme (Table 8).

The biophysical characteristics were classified as follows:
1 Group small amino acids with C-beta: AST
2. Backbone flexibility: G
3. Backbone rigidity: P
4. Positive charge: KR
5. Negative charge: ED
6. Medium sized polar NQH
7 Large Aromatic: FWY
8. Aliphatic: ILVMC

TABLE 8

Redcued alphabet consensus sequences of neutralizing antibodies

| ADI-Name | Parent | VH_GL | VL_GL | H3 | H3 | Cluster Number | Difference from Parent | Difference from Parent in Reduced alphabet |
|---|---|---|---|---|---|---|---|---|
| ADI-14583 | ADI-14583 | VH1-18 | VK2-30 | AREPPVIAAGDFQH (SEQ ID NO: 1902) | AREPPVIAAGDFQH (SEQ ID NO: 1902) | 1 | 0 | 0 |
| ADI-14336 | ADI-14583 | VH1-18 | VK2-30 | AREPPVIAAGDFQH (SEQ ID NO: 1902) | AREPPVIAAGDFQH (SEQ ID NO: 1902) | 1 | 0 | 0 |

TABLE 8-continued

Reduced alphabet consensus sequences of neutralizing antibodies

| ADI-Name | Parent | VH_GL | VL_GL | H3 | H3 | Cluster Number | Difference from Parent | Difference from Parent in Reduced alphabet |
|---|---|---|---|---|---|---|---|---|
| ADI-14402 | ADI-14583 | VH1-18 | VK2-30 | AREPPVIAAGDFSH (SEQ ID NO: 1903) | AREPPVIAAGDFSH (SEQ ID NO: 1903) | 1 | 1 | 1 |
| ADI-14576 | ADI-14583 | VH1-18 | VK2-30 | ARDPPVIAAGDFQH (SEQ ID NO: 1904) | ARDPPVIAAGDFQH (SEQ ID NO: 1904) | 1 | 1 | 0 |
| ADI-14577 | ADI-14583 | VH1-18 | VK2-30 | ARGPPVIAADDFQH (SEQ ID NO: 1905) | ARGPPVIAADDFQH (SEQ ID NO: 1905) | 1 | 2 | 2 |
| ADI-14585 | ADI-14583 | VH1-18 | VK2-30 | AREPPVIAAGDFPH (SEQ ID NO: 1906) | AREPPVIAAGDFPH (SEQ ID NO: 1906) | 1 | 1 | 1 |
| ADI-20975 | ADI-20975 | VH1-18 | VL3-21 | AREQFKWNDFYFDY (SEQ ID NO: 1907) | AREQFKWNDFYFDY (SEQ ID NO: 1907) | 2 | 0 | 0 |
| ADI-19422 | ADI-20975 | VH3-30 | VL3-21 | AKEDYNWNDYYFDY (SEQ ID NO: 1908) | AKEGYNWNDYYFDY (SEQ ID NO: 1908) | 2 | 5 | 2 |
| ADI-41788 | ADI-20975 | VH1-8 | VL3-21 | ARGFYKWNDWSFDY (SEQ ID NO: 1909) | ARGFYKWNDWSFDY (SEQ ID NO: 1909) | 2 | 5 | 3 |
| ADI-41191 | ADI-41191 | VH1-18 | VK2-30 | AREPPSLSAAATLDY (SEQ ID NO: 1910) | AREPPSLSAAATLDY (SEQ ID NO: 1910) | 3 | 0 | 0 |
| ADI-19501 | ADI-41191 | VH1-18 | VK2-30 | ARDPPSEGAAGLFDY (SEQ ID NO: 1911) | ARDPPSEGAAGLFDY (SEQ ID NO: 1911) | 3 | 6 | 5 |
| ADI-20962 | ADI-41191 | VH1-18 | VK2-30 | AREPPSDTAAGTGDY (SEQ ID NO: 1912) | AREPPSDTAAGTGDY (SEQ ID NO: 1912) | 3 | 4 | 3 |
| ADI-22757 | ADI-41191 | VH1-18 | VK2-30 | ARDPPAV-AASFMDV (SEQ ID NO: 1913) | ARDPPAV-AASFMDV (SEQ ID NO: 1913) | 3 | 8 | 3 |
| ADI-41424 | ADI-41191 | VH1-18 | VK2-30 | VRDTPAIAGAATLDF (SEQ ID NO: 1914) | VRDTPAIAGAATLDF (SEQ ID NO: 1914) | 3 | 8 | 3 |
| ADI-41454 | ADI-41191 | VH1-18 | VK2-30 | AREPPSTTAAATSDY (SEQ ID NO: 1915) | AREPPSTTAAATSDY (SEQ ID NO: 1915) | 3 | 3 | 2 |
| ADI-20964 | ADI-20964 | VH1-18 | VK2-30 | ARDVPVEAATSPEF (SEQ ID NO: 1916) | ARDVPVEAATSPEF (SEQ ID NO: 1916) | 4 | 0 | 0 |
| ADI-20988 | ADI-20964 | VH1-18 | VK2-30 | ARDVPVIAAHTFEY (SEQ ID NO: 1917) | ARDVPVIAAHTFEY (SEQ ID NO: 1917) | 4 | 5 | 3 |
| ADI-21050 | ADI-20964 | VH1-18 | VK2-30 | AREMGVDAAATFDY (SEQ ID NO: 1918) | AREMGVDAAATFDY (SEQ ID NO: 1918) | 4 | 9 | 2 |
| ADI-20974 | ADI-20974 | VH3-21 | VL1-40 | ARALMATAGGLAFDI (SEQ ID NO: 1919) | ARALMATAGGLAFDI (SEQ ID NO: 1919) | 5 | 0 | 0 |
| ADI-24839 | ADI-20974 | VH3-21 | VL1-40 | ARVLVATAYGNAFDI (SEQ ID NO: 1920) | ARVLVATAYGNAFDI (SEQ ID NO: 1920) | 5 | 4 | 3 |
| ADI-41203 | ADI-41203 | VH5-51 | VK3-15 | VSLYSDYDYGALDY (SEQ ID NO: 1921) | VSLYSDYDYGALDY (SEQ ID NO: 1921) | 6 | 0 | 0 |
| ADI-36680 | ADI-41203 | VH5-51 | VK3-15 | VSLFGDYDYGALDY (SEQ ID NO: 1922) | VSLFGDYDYGALDY (SEQ ID NO: 1922) | 6 | 2 | 1 |
| ADI-36681 | ADI-41203 | VH5-51 | VK3-15 | VTLYTDYDYGAPDH (SEQ ID NO: 1923) | VTLYTDYDYGAPDH (SEQ ID NO: 1923) | 6 | 4 | 2 |
| ADI-41344 | ADI-41344 | VH3-21 | VL1-40 | ARVSSPMIRGYYLDY (SEQ ID NO: 1924) | ARVSSPMIRGYYLDY (SEQ ID NO: 1924) | 7 | 0 | 0 |
| ADI-41343 | ADI-41344 | VH3-21 | VL1-40 | ARVDTPMVRGYYFDY (SEQ ID NO: 1925) | ARVDTPMVRGYYFDY (SEQ ID NO: 1925) | 7 | 4 | 2 |

Example 4. Exemplary Antibodies

Antibodies were assessed for RSV neutralization activity and polyreactivity. A set of antibodies with exemplary characteristics are provided in Tables 9A-C.

TABLE 9A

Antibody binding and functional characteristics

| Antibody No. | ADI Name | Neutralization - RSV A2 IC50 (pM) | neut IC50 (ug/ml) subtype A (graham) | neut IC50 (ug/ml) subtype B (graham) | neut IC50 (ug/ml) subtype A (wright) | Antigenic site | RSV PreF subtype A KD | RSV PostF subtype A KD | Polyreactivity score |
|---|---|---|---|---|---|---|---|---|---|
| Ab 2 | ADI-14334 | 189.2 | 0.05 | 0.11 | | Site III | 3.2E−10 | N.B. | 0.00 |
| Ab 71 | ADI-14405 | 58.3 | 0.04 | 0.04 | | Site IV (but preF-preferring) | 1.4E−10 | 1.2E−08 | 0.03 |
| Ab 112 | ADI-14583 | 124.6 | 0.05 | 0.06 | | Site V | 4.7E−10 | N.B. | 0 |
| Ab 217 | ADI-20964 | 162.4 | 0.06 | 0.14 | | Site V | 3.6E−10 | N.B. | 0 |
| Ab 227 | ADI-20974 | 75.4 | 0.003 | 0.09 | | Site III | 2.9E−10 | N.B. | 0.11 |
| Ab 228 | ADI-20975 | 67 | 0.05 | 0.49 | | unknown | 9.2E−11 | 1.5E−10 | 0.03 |
| Ab 249 | ADI-20998 | 74 | 0.03 | >25 | | Site 0 | 2.6E−10 | N.B. | 0.11 |
| Ab 466 | ADI-36669 | 110.9 | | | 0.025 | | 1.1E−09 | N.B. | 0.01 |
| Ab 467 | ADI-36670 | 141 | | | 0.008 | | 7.5E−10 | N.B. | 0.01 |
| Ab 469 | ADI-36672 | 206.7 | | | 0.018 | Likely site III | 7.0E−10 | N.B. | 0.07 |
| Ab 470 | ADI-36674 | 189.8 | | | 0.014 | Likely site III | 7.5E−10 | N.B. | 0.01 |
| Ab 832 | ADI-36676 | 130.1 | | | 0.006 | | 2.8E−10 | N.B. | 0 |
| Ab 471 | ADI-36677 | 144.1 | | | 0.019 | | 5.4E−10 | N.B. | 0.05 |
| Ab 516 | ADI-41191 | 154.1 | | | 0.071 | Likely site V | 5.0E−10 | N.B. | 0.08 |
| Ab 527 | ADI-41203 | 23.9 | | | 0.006 | | 4.0E−10 | N.B. | 0.05 |
| Ab 532 | ADI-41208 | 310.5 | | | 0.077 | Likely site III | 4.8E−10 | N.B. | 0.04 |
| Ab 543 | ADI-41221 | 65.4 | | | 0.040 | | 3.0E−10 | 3.2E−10 | 0.01 |
| Ab 544 | ADI-41222 | 39.9 | | | 0.016 | | 4.3E−10 | N.B. | 0.01 |
| Ab 551 | ADI-41229 | 228.2 | | | 0.066 | | 1.1E−09 | 7.1E−10 | 0 |
| Ab 554 | ADI-41232 | 103.9 | | | 0.025 | Likely site V | 7.1E−10 | N.B. | 0.00 |
| Ab 571 | ADI-41249 | 51.7 | | | 0.006 | | 3.9E−10 | N.B. | 0 |
| Ab 578 | ADI-41256 | 85.8 | | | 0.019 | | 3.5E−10 | N.B. | 0.00 |
| Ab 581 | ADI-41259 | 122 | | | 0.015 | | 3.4E−10 | N.B. | 0.00 |
| Ab 592 | ADI-41274 | 26.6 | | | 0.109 | Likely site III | 4.8E−10 | N.B. | 0.10 |
| Ab 615 | ADI-41302 | 132.9 | | | 0.006 | | 6.5E−10 | N.B. | 0.03 |
| Ab 641 | ADI-41344 | 228.6 | | | 0.064 | Likely site III | 4.9E−10 | N.B. | 0 |
| Ab 843 | ADI-41563 | 139.3 | | | 0.032 | | 6.0E−10 | N.B. | 0.12 |
| Ab 868 | ADI-41594 | 208.3 | | | 0.041 | Likely site III | 4.1E−10 | Weak binder (low response) | 0 |
| Ab 870 | ADI-41596 | 179.7 | | | 0.054 | | 3.0E−10 | 4.4E−10 | 0 |

TABLE 9B

Antibody VH sequence information

| Antibody No. | VH Germline | VH FR1 | VH CDR1 | VH FR2 | VH CDR2 | VH FR3 | VH CDR3 | VH FR4 |
|---|---|---|---|---|---|---|---|---|
| Ab 2 | VH3-11 | EVQLVESGGGLVKPGGSLRLSCAASG (SEQ ID NO: 1926) | VTVSSYMT (SEQ ID NO: 1927) | WVRQAPGKGLDISEFIS (SEQ ID NO: 1928) | SSSTYTNYADSVKG (SEQ ID NO: 1929) | RFTISRDNAKSSLYLARLGITVTGVGYFDLQMNNLRAEDTAVYYC (SEQ ID NO: 1930) | WGRGTLV (SEQ ID NO: 1931) | TVSS (SEQ ID NO: 1932) |
| Ab 71 | VH1-18 | QVQLVQSGTEVKKPGASVKVSCKASG (SEQ ID NO: 1933) | YTFTNYDIS (SEQ ID NO: 1934) | WVRQAPGQGLEWMG (SEQ ID NO: 1935) | WISGSTGNTIYAQNLQG (SEQ ID NO: 1936) | RLTMTTDTSTSTAYMARDNVGYASGNYFDYELRSLRSDDTAIYYC (SEQ ID NO: 1937) | WGQGTLV (SEQ ID NO: 1938) | TVSS (SEQ ID NO: 1939) |
| Ab 112 | VH1-18 | QVQLVQSGAEVKEPGASVKVSCKASG (SEQ ID NO: 1940) | YTFTNYGIS (SEQ ID NO: 1941) | WVRQAPGQGLEWLG (SEQ ID NO: 1942) | WISAYNGNIHYAQKVQG (SEQ ID NO: 1943) | RVTMTTDTSTSTGFMAREPPVIAAGDFQHELRSLRSDDTAVYYC (SEQ ID NO: 1944) | WGQGTLV (SEQ ID NO: 1945) | TVSS (SEQ ID NO: 1946) |
| Ab 217 | VH1-18 | QVQLVQSGAEVKKPGASVKVSCKASG (SEQ ID NO: 1947) | YTFTHYGIS (SEQ ID NO: 1948) | WVRQAPGQGLEWMG (SEQ ID NO: 1949) | WISAYNGNTNYAQKLQG (SEQ ID NO: 1950) | RVTMTTDTSTSTAYMARDVPVEAATSPEFEVRSLRYDDTAVYYC (SEQ ID NO: 1951) | WGQGTLV (SEQ ID NO: 1952) | TVSS (SEQ ID NO: 1953) |
| Ab 227 | VH3-21 | EVQLVESGGGLVKPGGSLRLSCAASG (SEQ ID NO: 1954) | FSFSSYQIN (SEQ ID NO: 1955) | WVRQAPGKGLSISEWVS (SEQ ID NO: 1956) | GGSSYTDYADSIKG (SEQ ID NO: 1957) | RFTISRDNAKKSAELARALMATAGGLAFDIQMKSLRADDTAVYYC (SEQ ID NO: 1958) | WGQGTMV (SEQ ID NO: 1959) | TVSS (SEQ ID NO: 1960) |

TABLE 9B-continued

Antibody VH sequence information

| Antibody No. | VH Germline | VH FR1 | VH CDR1 | VH FR2 | VH CDR2 | VH FR3 | VH CDR3 | VH FR4 |
|---|---|---|---|---|---|---|---|---|
| Ab 228 | VH1-18 | QVQLVESGTHVKK PGASVKVSCEASD (SEQ ID NO: 1961) | DTFNNKGIV (SEQ ID NO: 1962) | WVRQAPGQGLWIR (SEQ ID NO: 1963) | PNNGNTKYA QKEQG (SEQ ID NO: 1964) | RVTMTTDASTNTAYMAREQFKWNDFYFDY ELRSLRSGDTAVYYC (SEQ ID NO: 1965) | WGQGTLV (SEQ ID NO: 1966) | TVSS (SEQ ID NO: 1967) |
| Ab 249 | VH3-33 | QVQLVQSGGGVVQ PGRSLRLSCAASG (SEQ ID NO: 1968) | FTLSTYGMH (SEQ ID NO: 1969) | WVRQAPGKGLVIYY (SEQ ID NO: 1970) | DESNKFYA DSVQG (SEQ ID NO: 1971) | RFTISRDDSKNTLFLARESRPRGYSYSDFDW QMNSLRAEDTAVYYCS (SEQ ID NO: 1972) | (SEQ ID NO: 1973) | GQGTLV TVSS (SEQ ID NO: 1974) |
| Ab 466 | VH1-46 | EVQLVQSGAEVKK PGASVRVYCKASG (SEQ ID NO: 1975) | YTFTTYYIH (SEQ ID NO: 1976) | WVRQAPGQGLMIN (SEQ ID NO: 1977) | PSGGTTSYA QKFQG (SEQ ID NO: 1978) | RLTMTGDTSTSTVVYMTRDFIYFYGSGDGFDW ELNYLRSEDTAVYYCY (SEQ ID NO: 1979) | (SEQ ID NO: 1980) | GQGTLV TVSS (SEQ ID NO: 1981) |
| Ab 467 | VH1-69 | QVQLVQSGAEVKK PGSSVKVSCKASG (SEQ ID NO: 1982) | GTFSTYTIN (SEQ ID NO: 1983) | WVRQAPGQGLRIT (SEQ ID NO: 1984) | PSLGVPLSA QKFQG (SEQ ID NO: 1985) | RITISADKSTTTAYMASLNYYDTTDYYLGYW ELSSLGSEDTAVYYCSDS (SEQ ID NO: 1986) | (SEQ ID NO: 1987) | GQGTLV TVSS (SEQ ID NO: 1988) |
| Ab 469 | VH3-11 | EVQLVESGGGLVK PGGSLRLSCAASG (SEQ ID NO: 1989) | FAFNNYYMN (SEQ ID NO: 1990) | WVRQAPGKGLSIS (SEQ ID NO: 1991) | SSASTYTDYA DSVKG (SEQ ID NO: 1992) | RFTISRDNAKNSLYLARDYYGSGNYYNPKPW HLNSLRAEDTAVYYCLDV (SEQ ID NO: 1993) | (SEQ ID NO: 1994) | GQGTTV TVSS (SEQ ID NO: 1995) |
| Ab 470 | VH3-21 | EVQLLESGGGLVK PGGSLRLSCAASG (SEQ ID NO: 1996) | FKFRSYSMN (SEQ ID NO: 1997) | WVRQAPGKGLSIS (SEQ ID NO: 1998) | SSSSSYVDYA GSEKG (SEQ ID NO: 1999) | RFTISRDNAENSLYLARAGSVPVAGTYNDYW QMNSLRAEDTAMYYC (SEQ ID NO: 2000) | (SEQ ID NO: 2001) | GQGTLV TVSS (SEQ ID NO: 2002) |
| Ab 832 | VH3-30 | EVQLLESGGGVVQ PGRSLRLSCAASG (SEQ ID NO: 2003) | FSFRNYDMH (SEQ ID NO: 2004) | WVRQAPGKGLIIS (SEQ ID NO: 2005) | YDGSNK- YADSVKG (SEQ ID NO: 2006) | RFTISRDTSKNTLYLARADSSGYYKGSEYFW QMNSLRVEDTAVYYCQH (SEQ ID NO: 2007) | (SEQ ID NO: 2008) | GQGTLV TVSS (SEQ ID NO: 2009) |
| Ab 471 | VH3-48 | QVQLVQSGGGLVQ PGGSLRLSCAASG (SEQ ID NO: 2010) | FTFSSYEMN (SEQ ID NO: 2011) | WVRQAPGKGLYIS (SEQ ID NO: 2012) | SSGDTKYYA DSVKG (SEQ ID NO: 2013) | RFTVSRDNAKYSLYLASLYDSRGYYWVFDYW QMDSLRAEDTAVYYC (SEQ ID NO: 2014) | (SEQ ID NO: 2015) | GQGTLV TVSS (SEQ ID NO: 2016) |
| Ab 516 | VH1-18 | QVQLVQSGAEVKR PGASVKVSCKASG (SEQ ID NO: 2017) | YIFSHYGIS (SEQ ID NO: 2018) | WVRQAPGQGLWIS (SEQ ID NO: 2019) | AYNGNTNYA QKLQG (SEQ ID NO: 2020) | RVTVTTDTSTSTAYMAREPPSLSAAATLDYW ELRSLRSDDTAVYYC (SEQ ID NO: 2021) | (SEQ ID NO: 2022) | GQGTLV TVSS (SEQ ID NO: 2023) |
| Ab 527 | VH5-51 | QVQLVQSGAEVRK PGESLKISCKASG (SEQ ID NO: 2024) | YRFTNYWIG (SEQ ID NO: 2025) | WVRQMPGKGLVIY (SEQ ID NO: 2026) | PGDSDTRYS PSFQG (SEQ ID NO: 2027) | QVTMSADKSTNTAYLVSLYSDYDYGALDY QWSSLKASDTAIYYC (SEQ ID NO: 2028) | WGQGTLV (SEQ ID NO: 2029) | TVSS (SEQ ID NO: 2030) |
| Ab 532 | VH3-11 | QVQLVESGGDLVK PGGSLRLSCAASG (SEQ ID NO: 2031) | FTLSGHYMS (SEQ ID NO: 2032) | WIRQPPGKGLSIS (SEQ ID NO: 2033) | GSSTYTNYA DSVKG (SEQ ID NO: 2034) | RFTISRDNAENSLYLARLAYSDYGPFYFDLW QMNSLRAEDTAVYYC (SEQ ID NO: 2035) | (SEQ ID NO: 2036) | GRGTLV TVSS (SEQ ID NO: 2037) |
| Ab 543 | VH3-21 | EVQLLESGGGLVK PGGSLRLSCAASG (SEQ ID NO: 2038) | FTFSDYTMN (SEQ ID NO: 2039) | WVRQAPGKGLSIS (SEQ ID NO: 2040) | ITSSHIYYA DSVKG (SEQ ID NO: 2041) | RFTISRDNAKNSLYLARELGFASSSYYYW QINSLRAEDTAAYYCGMDV (SEQ ID NO: 2042) | (SEQ ID NO: 2043) | GQGTTV TVSS (SEQ ID NO: 2044) |
| Ab 544 | VH3-30 | QVTLKESGGGVVQ PGRSQRLSCTASG (SEQ ID NO: 2045) | FNFHNYAMH (SEQ ID NO: 2046) | WVRQAPGKGLVIS (SEQ ID NO: 2047) | YDGSNKNFA DSVKG (SEQ ID NO: 2048) | RFTISRDNSKNTLNLVRDIVRGSPLFDY QMNNLRAEDTAVYYC (SEQ ID NO: 2049) | (SEQ ID NO: 2050) | WGQGTLV TVSS (SEQ ID NO: 2051) |
| Ab 551 | VH3-30 | QVQLVDSGGGVVQ PGRSLKLSCAASG (SEQ ID NO: 2052) | FTFKSYGMH (SEQ ID NO: 2053) | WVRQAPGKGLVIS (SEQ ID NO: 2054) | YDEINKYYA DSVKG (SEQ ID NO: 2055) | RFTISRDYSKNTLSLAKPKTTGYYYLDAFDW QMNSLTTEDTAMYYCF (SEQ ID NO: 2056) | (SEQ ID NO: 2057) | GQGTMV TVSS (SEQ ID NO: 2058) |

TABLE 9B-continued

Antibody VH sequence information

| Antibody No. | VH Germline | VH FR1 | VH CDR1 | VH FR2 | VH CDR2 | VH FR3 | VH CDR3 | VH FR4 |
|---|---|---|---|---|---|---|---|---|
| Ab 554 | VH1-18 | QVQLVQSGAEVKKPGASVKVSCKASG (SEQ ID NO: 2059) | YTFTHYGIS (SEQ ID NO: 2060) | WVRQAPGQGLEWMA (SEQ ID NO: 2061) | WISAYNGNTNYAQKLQD (SEQ ID NO: 2062) | RVTVTTDTSTSTAYMELRSLRSDDTALYYC (SEQ ID NO: 2063) | ARDSMGGTTLFDY (SEQ ID NO: 2064) | WGQGTLVTVSS (SEQ ID NO: 2065) |
| Ab 571 | VH5-51 | QVQLVQSGAEVKKPGESLKISCQVSR (SEQ ID NO: 2066) | DTSTTYWIG (SEQ ID NO: 2067) | WVRQMPGKGLIEWMG (SEQ ID NO: 2068) | IIFPGDSDTRYSPSFQG (SEQ ID NO: 2069) | QVTISADKSIMTAYLQLTSLKASDTAMYYC (SEQ ID NO: 2070) | ATQALRGAFDI (SEQ ID NO: 2071) | WGQGTMVTVSS (SEQ ID NO: 2072) |
| Ab 578 | VH1-69 | QVQLVQSGAEVKSPGSSATVSCKASG (SEQ ID NO: 2073) | GTFGSYGIS (SEQ ID NO: 2074) | WVRQAPGQGLAEWIG (SEQ ID NO: 2075) | IMPMFGTINYAQKFQG (SEQ ID NO: 2076) | RVTMTADESTSTVYMDVSSLRPDDTAVYYC (SEQ ID NO: 2077) | VRDVFYDILTGYYDAWGKGTTV (SEQ ID NO: 2078) | TVSS (SEQ ID NO: 2079) |
| Ab 581 | VH3-11 | QVQLVESGGRLVKPGGSLRLSCAASG (SEQ ID NO: 2080) | FTFSDFYMS (SEQ ID NO: 2081) | WIRQAPGKGLEWVS (SEQ ID NO: 2082) | YISSSGDDPNYADSVKG (SEQ ID NO: 2083) | RFTISRDNSKNSLYLAQMNSLRAEDTAVYYC | RDEVGWNNLDYYFGWGQGTTV (SEQ ID NO: 2084) | MDV (SEQ ID NO: 2085) TVSS (SEQ ID NO: 2086) |
| Ab 592 | VH3-21 | EVQLVESGGGLVKPGGSLRLSCAASG (SEQ ID NO: 2087) | FSFSSYAMN (SEQ ID NO: 2088) | WVRQAPGKGLSQWVS (SEQ ID NO: 2089) | ISAGSSYIDYADSVKG (SEQ ID NO: 2090) | RFTISRDNAENSLFLARQMNSLRVEDTAVYYC (SEQ ID NO: 2091) | VGSYTHGYEFDY (SEQ ID NO: 2092) | WGQGTLVTVSS (SEQ ID NO: 2093) |
| Ab 615 | VH3-30 | QVQLVESGGGVVQPGRSLRLSCAASG (SEQ ID NO: 2094) | FTFSSYAMQ (SEQ ID NO: 2095) | WVRQAPGKGLVEWVA (SEQ ID NO: 2096) | MTNDGDDKYYADSVRG (SEQ ID NO: 2097) | RFTISRDNSKNTLYLAQMNNLRPEDTAVYYC (SEQ ID NO: 2098) | RDLFEWWELLGYCWGQGTTV (SEQ ID NO: 2099) | MDV TVSS (SEQ ID NO: 2100) |
| Ab 641 | VH3-21 | EVQLVESGGGLVKPGGSLRLSCAASG (SEQ ID NO: 2101) | SSFSSYYMN (SEQ ID NO: 2102) | WVRQAPGKGLSEWVS (SEQ ID NO: 2103) | ISSSSSTYIDYADSVKG (SEQ ID NO: 2104) | RFTISRDNAKNSLFLARQMNSLRAEDTAVYYC (SEQ ID NO: 2105) | VSSPMIRGYYLDY (SEQ ID NO: 2106) | WGQGTLVTVSS (SEQ ID NO: 2107) |
| Ab 843 | VH4-59 | QVQLYESGPGLVKPSETLSLTCTVSD (SEQ ID NO: 2108) | DSITNNFWT (SEQ ID NO: 2109) | WIRQPPGKGLYEWIG (SEQ ID NO: 2110) | IYYSGSTNYNPSLKS (SEQ ID NO: 2111) | RITNSVDLSKNQFSLAKLSSVTAADTAVYYC (SEQ ID NO: 2112) | RLTSGGVDY (SEQ ID NO: 2113) | WGQGTLVTVSS (SEQ ID NO: 2114) |
| Ab 868 | VH3-21 | EVQLVESGGGLVKPGGSLRLSCAASG (SEQ ID NO: 2115) | FSFSSYYMN (SEQ ID NO: 2116) | WVRQAPGKGLSEWVS (SEQ ID NO: 2117) | ISPSSSYTNYADSVKG (SEQ ID NO: 2118) | RFTISRDNAKDSLYLAQMNSLRAEDTAVYYC (SEQ ID NO: 2119) | RDGLLGITIFGVV (SEQ ID NO: 2120) DY | WGQGTLVTVSS (SEQ ID NO: 2121) |
| Ab 870 | VH4-34 | QVQLQQWGAGLLKPSETLSLTCAVYG (SEQ ID NO: 2122) | DSFSGYFWT (SEQ ID NO: 2123) | WIRQPPGKGLEWIG (SEQ ID NO: 2124) | INLSGSTNYNPSLKS (SEQ ID NO: 2125) | RVTILVDTSKNQFSLAKLSSVTAADTAVYYC (SEQ ID NO: 2126) | RGLHVSDDQDSSGYWGQGTLV (SEQ ID NO: 2027) YFHPGSFDY | TVSS (SEQ ID NO: 2128) |

TABLE 9C

Antibody VL sequence information

| Antibody No. | VL Germline | VL FR1 | VL CDR1 | VL FR2 | VL CDR2 | VL FR3 | VL CDR3 | VL FR4 |
|---|---|---|---|---|---|---|---|---|
| Ab 2 | VL1-40 | QPGLTQPPSVSGAPGQRVTISC (SEQ ID NO: 2129) | TGSSSNIGAGYDVH (SEQ ID NO: 2130) | WYQQLPGTAPKLLIN (SEQ ID NO: 2131) | DNNNRPS (SEQ ID NO: 2132) | GVPDRFSGSKSGTSASLAITGLQVEDEADYYC (SEQ ID NO: 2133) | QSYDSSLSNYV (SEQ ID NO: 2134) | FGTGTKLTVL (SEQ ID NO: 2135) |
| Ab 71 | VL3-21 | SYVLTQPPSVSVAPGKTARIPC (SEQ ID NO: 2136) | GGNNIGSKSVH (SEQ ID NO: 2137) | WYQQRPGQAPVLVIY (SEQ ID NO: 2138) | YDSVRPS (SEQ ID NO: 2139) | GIPERFSGSNSGNTATLTISTVEAGDEADPYC (SEQ ID NO: 2140) | QVWDSSRDHEV (SEQ ID NO: 2141) | FGGGTKLTVL (SEQ ID NO: 2142) |

TABLE 9C-continued

Antibody VL sequence information

| Antibody No. | VL Germline | VL FR1 | VL CDR1 | VL_FR2 | VL CDR2 | VL FR3 | VL CDR3 | VL FR4 |
|---|---|---|---|---|---|---|---|---|
| Ab 112 | VK2-30 | ETTLTQSPLSLPVTLGQPASISC (SEQ ID NO: 2143) | RSSQSLVHSNGNTYLS (SEQ ID NO: 2144) | WFQQRPGQSPRRLIY (SEQ ID NO: 2145) | RVSNRDS (SEQ ID NO: 2146) | GVPDRFSGSGSGTDFTLKISRVEAEDVGLYYC (SEQ ID NO: 2147) | MQGTHWPPD (SEQ ID NO: 2148) | FGQGTRLEIK (SEQ ID NO: 2149) |
| Ab 217 | VK2-30 | DIVMTQTPLSLPVTLGQPASISC (SEQ ID NO: 2150) | RSSQSLVYSDGNTYLS (SEQ ID NO: 2151) | WFQQRPGQSPRRLIY (SEQ ID NO: 2152) | KVSNRDS (SEQ ID NO: 2153) | GVPNRFSGSGSGTDFTLKISRVEAEDVGVYYC (SEQ ID NO: 2154) | VQNTHWPAYT (SEQ ID NO: 2155) | FGQGTKVEIK (SEQ ID NO: 2156) |
| Ab 227 | VL1-40 | QPVLTQPPSVSGAPGQRVTISC (SEQ ID NO: 2157) | TGSGSNIGAGYDVH (SEQ ID NO: 2158) | WYQQVPGTAPKLLIL (SEQ ID NO: 2159) | RNTNRPS (SEQ ID NO: 2160) | GVPDRFSGSKSGTSASLAITGLQAEDEADYYC (SEQ ID NO: 2161) | QSYDRSLSVV (SEQ ID NO: 2162) | FGGGTKLTVL (SEQ ID NO: 2163) |
| Ab 228 | VL3-21 | SYELMQPPSVSVAPGQTATITC (SEQ ID NO: 2164) | GGSNIGSETVH (SEQ ID NO: 2165) | WYQQKPGQAPVLVVH (SEQ ID NO: 2166) | DDTDRPS (SEQ ID NO: 2167) | GIPERFSGSNSGNTATLTISGVEAGDEADFYC (SEQ ID NO: 2168) | QVRDSRTDDVV (SEQ ID NO: 2169) | FGGGTKLTVL (SEQ ID NO: 2170) |
| Ab 249 | VL2-11 | QPGLTQPRSVSGSPGQSVTISC (SEQ ID NO: 2171) | TGTSSDVGTFNYVS (SEQ ID NO: 2172) | WYQQHPGKAPKLMIY (SEQ ID NO: 2173) | DVNQRPS (SEQ ID NO: 2174) | GVPDRFSGSKSGNTASLTISGLQAEDEADYYC (SEQ ID NO: 2175) | CAYAGYYS (SEQ ID NO: 2176) | FGGGTKLTVL (SEQ ID NO: 2177) |
| Ab 466 | VK1-17 | EICMTQSPSAMSASVGDRVTITC (SEQ ID NO: 2178) | RASQGISNYLA (SEQ ID NO: 2179) | WFQQKPGKVPKRLIY (SEQ ID NO: 2180) | AASSLQS (SEQ ID NO: 2181) | GVPSRFSGSGSGTEFTLTITSLQPEDFATYYC (SEQ ID NO: 2182) | LQHNSYPFT (SEQ ID NO: 2183) | FGPGTKVEIK (SEQ ID NO: 2184) |
| Ab 467 | VK3-15 | DIVLTQTPATLSVSPGERATLSC (SEQ ID NO: 2185) | RASHSVSNNLA (SEQ ID NO: 2186) | WYQQKPGQAPRLLIY (SEQ ID NO: 2187) | SASTRAT (SEQ ID NO: 2188) | GIPARFSGRGSGTEFTLTISSLQPEDFAVYYC (SEQ ID NO: 2189) | QQYNNWPPEYT (SEQ ID NO: 2190) | FGQGTKVDIK (SEQ ID NO: 2191) |
| Ab 469 | VL1-40 | QPVLTQPPSVSGAPGQRVTISC (SEQ ID NO: 2192) | TGSSSNIGAGYDVH (SEQ ID NO: 2193) | WYRQFPGTAPELLIY (SEQ ID NO: 2194) | GNTNRPS (SEQ ID NO: 2195) | GVPDRFSGSKSGTSASLAITGLQAEDEADYYC (SEQ ID NO: 2196) | QSYDSSLKGV (SEQ ID NO: 2197) | FGGGTKLTVL (SEQ ID NO: 2198) |
| Ab 470 | VL1-40 | QSVLTQPPSVSGAPGQRVTISC (SEQ ID NO: 2199) | TGSSSNIGAGYDVH (SEQ ID NO: 2200) | WYQHLPGTAPKLLIH (SEQ ID NO: 2201) | GNNNRPA (SEQ ID NO: 2202) | GVPDRFSGSKSGTSASLVITGLQADDEADYYC (SEQ ID NO: 2203) | QSYDRSLSVL (SEQ ID NO: 2204) | FGGGTKVTVL (SEQ ID NO: 2205) |
| Ab 832 | VL3-21 | SYELTQLPSVSVAPGQTARITC (SEQ ID NO: 2206) | GGNNIGTKSVQ (SEQ ID NO: 2207) | WYQHKPGQAPVLVVY (SEQ ID NO: 2208) | DDSDRPS (SEQ ID NO: 2209) | DIPERFSGSNSGNTATLTISRVEAGDEADYYC (SEQ ID NO: 2210) | QVWDSSSDHYV (SEQ ID NO: 2211) | FGTGTKLTVL (SEQ ID NO: 2212) |
| Ab 471 | VK1-33 | DIVMTQSPSSLSASVGDRVTITC (SEQ ID NO: 2213) | QASQDISTYLNNLLIY (SEQ ID NO: 2214) | WYQHKPGKAP (SEQ ID NO: 2215) | DASNLEP (SEQ ID NO: 2216) | GVPSRFSGSGSGTDFTFTISSLQPEDIATYYC (SEQ ID NO: 2217) | LQHDNLPPT (SEQ ID NO: 2218) | FGQGTKVDIK (SEQ ID NO: 2219) |
| Ab 516 | VK2-30 | EIVMTQSPLSLPVTLGQPASISC (SEQ ID NO: 2220) | RSNQSLVYSDGNIYLS (SEQ ID NO: 2221) | WFQQRPGQSPRRLIY (SEQ ID NO: 2222) | KVSNRDS (SEQ ID NO: 2223) | GVPDRFSGSGSGTDFTLKISRVEAEDVAVYYC (SEQ ID NO: 2224) | MQVTHWPHE (SEQ ID NO: 2225) | FGQGTKLEIK (SEQ ID NO: 2226) |
| Ab 527 | VK3-15 | EIVMTQSPATLSVSPGERATLSC (SEQ ID NO: 2227) | RASENVGRNLA (SEQ ID NO: 2228) | WYQQKPGQAPRLLIY (SEQ ID NO: 2229) | GASIRAT (SEQ ID NO: 2230) | GILARFSGSGSGTEYTLTISSLQSEDFAVYYC (SEQ ID NO: 2231) | QQYHDWPSFT (SEQ ID NO: 2232) | FGPGTKVDIK (SEQ ID NO: 2233) |
| Ab 532 | VL1-40 | QSVLTQPPSVSGAPGQRVTISC (SEQ ID NO: 2234) | TGSSSNIGAGYDVH (SEQ ID NO: 2235) | WYQQLTGTAPKLLIF (SEQ ID NO: 2236) | DNNNRPS (SEQ ID NO: 2237) | GVPDRFSGSKSGTSASLAITGLQAEDEADYYC (SEQ ID NO: 2238) | QSYDSRLSAPYV (SEQ ID NO: 2239) | FGTGTKLTVL (SEQ ID NO: 2240) |

TABLE 9C-continued

Antibody VL sequence information

| Antibody No. | VL Germline | VL FR1 | VL CDR1 | VL FR2 | VL CDR2 | VL FR3 | VL CDR3 | VL FR4 |
|---|---|---|---|---|---|---|---|---|
| Ab 543 | VL2-11 | QSALTQPRSVSGS PGQSVTISC (SEQ ID NO: 2241) | TGTSSDVGDYN SVS (SEQ ID NO: 2242) | WYQQHPGTAP KLIIF (SEQ ID NO: 2243) | DVTQRPS (SEQ ID NO: 2244) | GVPDRFSGSKSANTASL TISGLQPEDEADYY- (SEQ ID NO: 2245) | CCSFAGNYV (SEQ ID NO: 2246) | FGTGTKV TVL (SEQ ID NO: 2247) |
| Ab 544 | VL3-21 | QPVLTQPPSLSVA PGQTAWITC (SEQ ID NO: 2248) | GGNNIGSKIVH (SEQ ID NO: 2249) | WYQQKPGQAP VVVVY (SEQ ID NO: 2250) | DDDDRPS (SEQ ID NO: 2251) | GIPERFSGSNSGNTATL TIRRVEVGDEADYYC (SEQ ID NO: 2252) | QVWDRSSDNYV (SEQ ID NO: 2253) | FGTGTKV SVL (SEQ ID NO: 2254) |
| Ab 551 | VK1-33 | ETTLTQSPSSLSA SVGDRVTITC (SEQ ID NO: 2255) | QASQDISNYLN (SEQ ID NO: 2256) | WYQQKPGKAP KLLIY (SEQ ID NO: 2257) | DASNLET (SEQ ID NO: 2258) | GVPSRFSGSGSGTDFTF TISSLQSEDIATYYC (SEQ ID NO: 2259) | QQHDNVPPT (SEQ ID NO: 2260) | FGQGTKV DIK (SEQ ID NO: 2261) |
| Ab 554 | VK2-30 | DIVLTQTPLSLPV TLGQPASISC (SEQ ID NO: 2262) | RSSQSLVYSDG NTYLN (SEQ ID NO: 2263) | WFQQRPGQSP RRLIY (SEQ ID NO: 2264) | KVSNRDS (SEQ ID NO: 2265) | GVPDRFTGSGSGTDFTL KISRVEAEDVGVYYC (SEQ ID NO: 2266) | MQGTHWPPMYT (SEQ ID NO: 2267) | FGQGTKL EIK (SEQ ID NO: 2268) |
| Ab 571 | VK1-33 | DIRLTQSPSSLSA SVGDRVTITC (SEQ ID NO: 2269) | QASQDISNYLN (SEQ ID NO: 2270) | WYQQKPGKAP KLLIY (SEQ ID NO: 2271) | DASYLET (SEQ ID NO: 2272) | GVPSRFSGSGSGTDFTF TISSLQPEDFATYYC (SEQ ID NO: 2273) | QQYDDLLFT (SEQ ID NO: 2274) | FGPGTKL EIK (SEQ ID NO: 2275) |
| Ab 578 | VK2-30 | DIVMTQSPLSLPV TLGQPASISC (SEQ ID NO: 2276) | RSGQSLVHSDG NTYLN (SEQ ID NO: 2277) | WFQQRPGQSP RRLIY (SEQ ID NO: 2278) | KVSNRGS (SEQ ID NO: 2279) | GVPDRFSGSGSGTDFTL KISRVEAEDVGVYFC (SEQ ID NO: 2280) | MQGTHWPRT (SEQ ID NO: 22281) | FGQGTKV DIK (SEQ ID NO: 2282) |
| Ab 581 | VK2-30 | DIVMTQSPLSLPV TLGQPASISC (SEQ ID NO: 2283) | RSSQSLVHSDG NTYLS (SEQ ID NO: 2284) | WFHQRPGQSP RRLIY (SEQ ID NO: 2285) | KVSNRDS (SEQ ID NO: 2286) | GVPNRFSGGGSGTDFTL KISRVEAEDVGFFYC (SEQ ID NO: 2287) | MQGTHWQKT (SEQ ID NO: 2288) | FGQGTKV EIK (SEQ ID NO: 2289) |
| Ab 592 | VL1-40 | QPVLTQPPSVSGA PGQRVTISC (SEQ ID NO: 2290) | TGSNSNIGAGY DVH (SEQ ID NO: 2291) | WYQQLPGTAP KLLIY (SEQ ID NO: 2292) | ASTIRPS (SEQ ID NO: 2293) | GVPDRFSGSKSGTSASL AITGLQAEDEADYYC (SEQ ID NO: 2294) | QSYDRNLSVV (SEQ ID NO: 2295) | FGGGTKV TVL (SEQ ID NO: 2296) |
| Ab 615 | VL2-8 | QSVLTQPPSASGS PGQSVTISC (SEQ ID NO: 2297) | TGTSSDVGAYN YVS (SEQ ID NO: 2298) | WYQQHPGKAP KLIIY (SEQ ID NO: 2299) | EVYKRPS (SEQ ID NO: 2300) | GVPDRFFGSKSGNTASL TVSGLQAEDEADYYC (SEQ ID NO: 2301) | SSYAGSNTLGV (SEQ ID NO: 2302) | FGGGTKV TVL (SEQ ID NO: 2303) |
| Ab 641 | VL1-40 | QPVLTQPPSVSGA PGQRVTISC (SEQ ID NO: 2304) | TGSSSNIGAGY DVH (SEQ ID NO: 2305) | WYQQLPGTAP KLVIH (SEQ ID NO: 2306) | GNSNRPS (SEQ ID NO: 2307) | GVPDRFSGSKSGTSASL AITGLQDEDEADYYC (SEQ ID NO: 2308) | QSYDSSLSGSV (SEQ ID NO: 2309) | FGGGTKL TVL (SEQ ID NO: 2310) |
| Ab 843 | VL1-40 | QSVLTQPPSLSGA PGQRVTISC (SEQ ID NO: 2311) | TGSSSNIGADY HVH (SEQ ID NO: 2312) | WYQQLPGTAP KLLIY (SEQ ID NO: 2313) | QNTNRPS (SEQ ID NO: 2314) | GVPDRFSASKSGTSVSL AITGLQAEDEADYYC (SEQ ID NO: 2315) | QSYDSSLSAWV (SEQ ID NO: 2316) | FGGGTKL TVL (SEQ ID NO: 2317) |
| Ab 868 | VL1-40 | QSVVTQPPSVSGA PGQRVTISC (SEQ ID NO: 2318) | TGSSSNIGAGY DVH (SEQ ID NO: 2319) | WYQQLPGTAP KLLIY (SEQ ID NO: 2320) | GNTNRPS (SEQ ID NO: 2321) | GVPDRFSASKSGTSASL AITGLQAEDEADYYC (SEQ ID NO: 2322) | QSYDSSLSVV (SEQ ID NO: 2323) | FGGGTKL TVL (SEQ ID NO: 2324) |
| Ab 870 | VK4-1 | DIRMTQSPDSLAV SLGERATINC (SEQ ID NO: 2325) | KSSQSVLYSSN NKNYLA (SEQ ID NO: 2326) | WYQQKPGQPP KLLIN (SEQ ID NO: 2327) | WASTRES (SEQ ID NO: 2328) | GVPDRFSGSGSGTDFTL AISSLQAEDVAVYYC (SEQ ID NO: 2329) | QQYYSTPLT (SEQ ID NO: 2330) | FGGGTKV EIK (SEQ ID NO: 2331) |

An informal sequence listing is provided below in Table 5.

TABLE 5

Informal Sequence Listing

| Antibody No. | Clone # (ADI) | SEQ ID NO: | Sequence | Descriptors |
|---|---|---|---|---|
| Ab 1 | ADI-14333 | 1 | EVQLVETGGGLVKPGGSLRLSCADSGFPFSSYSMHWVRQAPGKGLEWVASISSSSS FINYADSVKGRFTISRDNAKNSLYLQMNSLRAEDTAVYFCAREAACGGDCYGYYFD YWGQGTLVTVSS | Heavy chain variable region ("HC") amino acid sequence |
| Ab 1 | ADI-14333 | 2 | QSVVTQPPSASGAPGQRVTISCTGSSSNIGAGYDVHWYQQLPGTAPKVLISGNSNR PSGVPARFSGSKSGTSASLAITGLQAEDEADYYCQSYDSSLSGSVEGGGTQLTVL | Light chain variable region ("LC") amino acid sequence |
| Ab 2 | ADI-14334 | 3 | EVQLVESGGGLVKPGGSLRLSCAASGVTVSSYYMTWVRQAPGKGLEFISDISSSSTY TNYADSVKGRFTISRDNAKSSLYLQMNNLRAEDTAVYYCARLGITVTGVGVFDLWG RGTLVTVSS | Heavy chain variable region ("HC") amino acid sequence |
| Ab 2 | ADI-14334 | 4 | QPGLTQPPSVSGAPGQRVTISCTGSSSNIGAGYDVHWYQQLPGTAPKLLIHDNNN RPSGVPDRFSGSKSGTSASLAITGLQVEDEADYYCQSYDSSLSNVFGTGTKLITVL | Light chain variable region ("LC") amino acid sequence |
| Ab 3 | ADI-14335 | 5 | EVQLVESGGGLVQPGRSLRLSCTASGFTFGDYAMSWVRQAPGKGLEWVGFIRSN AFGGTSEYAASVKGRFTISRDDSKSIAYLQMNSLKTEDTAVYYCTRDGIHDYGDSYY YYGMDVWGQGTTVTVSS | Heavy chain variable region ("HC") amino acid sequence |
| Ab 3 | ADI-14335 | 6 | DIQLTQSPSSLSASVGDRVTITCRASQTVTTYLNWYQQKPGKAPKLLIYGASSLQSG VPSRFSGSGSGTDFTLTINSLQPEDFATYYCQQTYSTVTFGPGTKVEIK | Light chain variable region ("LC") amino acid sequence |
| Ab 4 | ADI-14336 | 7 | EVQLLESGGEVKKPGASVKVSCKASGYTFTNYGISWVRQAPGQGLEWMGWISAY NGNTNYAQKLQGRVTWTTDTSTSTAYMEVRRLRSDDTAVYYCAREPPVIAAGDFQ HWGQGTLVTVSS | Heavy chain variable region ("HC") amino acid sequence |
| Ab 4 | ADI-14336 | 8 | DIVMTQTPLSLPVTLGQPASISCRSSQSLVHSDTNIYLSWFQQRPGQSPPRLLIYKVSN RDSGVPDRFSGSGSGTDFTLRISRVEAEDVGVYYCMQGTHWPPDFGQGTRLEIK | Light chain variable region ("LC") amino acid sequence |
| Ab 5 | ADI-14337 | 9 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCAREYDSSGYTNWFDP WGQGTLVTVSS | Heavy chain variable region ("HC") amino acid sequence |
| Ab 5 | ADI-14337 | 10 | QPVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLAWVEGGGTQLTVL | Light chain variable region ("LC") amino acid sequence |
| Ab 6 | ADI-14338 | 11 | EVQLVESGGGVVQPGRPLRLSCAASGFTFSTYDLVWVRQAPGKGLDWVALISPDG NKKYYADSVKGRFTISRDNSKNTLFLHMNSLRAEDTAVYYCARDYGNYFGSGSYYR YFDLWGRGTLVTVSS | Heavy chain variable region ("HC") amino acid sequence |
| Ab 6 | ADI-14338 | 12 | DIQLTQSPSSLSASVGDRVTITCRASQSISSHLNWYQQKPGKAPKLLIYASSLQSGV PSRFSGSGSGTDFTLTISGLQPEDFATYYCQQSYSTPFTFGPGTKVEIK | Light chain variable region ("LC") amino acid sequence |
| Ab 7 | ADI-14339 | 13 | QVQLVESGGGVLQPGRSLRLPCEASGTFNKYAMHWVRQAPGKGLEWVAVSY DGGNKFYAESVKGRFTISRDNSKNTLYLQMNSLKPEDTAVYYCARDRWELLHGLDY WGLGTLVTVSS | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 7 | 14 | SYELTQPPSVSVSPGQTARITCSGEALAKQYAYWYQQKPGQAPVLVIYKDNERPSGI SERFSGSGSGTTVTLTISGVQAEDEADYYCQSADSSGTYVFGTGTKVTVL | ADI-14339 | Light chain variable region ("LC") amino acid sequence |
| Ab 8 | 15 | EVQLVESGGGLVKPGGSLRLSCAASGFTLSSYTMNWVRQAPGRGLEWVSSIYSTSS YIYYADSVKGRPFTISRDNAKNSLYLQMNSLRAEDTAVYYCARDSQAVTGTDLYFDS WGQGTLVTVSS | ADI-14340 | Heavy chain variable region ("HC") amino acid sequence |
| Ab 8 | 16 | QPGLTQPPSVSVAPGKTARITCGGNNIGRKNVHWYQQKPGQAPILVLYDSDRPS GIPERFSGSNSGNTATLTISRVEDGDEADYYCQVWDSSNDHVIFGGGTQLTVL | ADI-14340 | Light chain variable region ("LC") amino acid sequence |
| Ab 9 | 17 | QVQLVQSGGGLVQPGGSLRLSCAGSGFTFSDYEMNWVRQAPCKGLEWLSYISSS GSIIYYADSVKGRFTISRDNAKNSLYLQMNSLRAEDTGLYYCARANHRHYYGMDV WGQGTTVTVSS | ADI-14341 | Heavy chain variable region ("HC") amino acid sequence |
| Ab 9 | 18 | DIRLTQSPSTLSASVGDRVTITCRASQSIGSWLAWYQQKPGKAPKLLIYKASSLESGV PSRFSGSGSGTEFTLTISSLQPDDFATYYCQQYNSYSYTFGRGTRLEIK | ADI-14341 | Light chain variable region ("LC") amino acid sequence |
| Ab 10 | 19 | QVTLKESGPVLVKPTETLTLTCTVSGFSLSNAKMGVSWIRQPPGKALEWLAYISSND EKSYSTSLKSRLTISKDTSKSQVVLTMTNMDPVDTATYYCARILLYDSSGYYLWYFDL WGRGTLVTVSS | ADI-14342 | Heavy chain variable region ("HC") amino acid sequence |
| Ab 10 | 20 | DIQVTQSPSSLSASVGDRVTITCRASQRITSYLNWYQHKPGKAPKLLIFAASSLHSGV PSTFSGSGSGTDFTLTISSLQPEDFATYYCQQSYSTPWTFGQGTKVEIK | ADI-14343 | Light chain variable region ("LC") amino acid sequence |
| Ab 11 | 21 | QVQLVQSGAEVKKPGSSVKVSCKAASGGTFSSYGVNWVRQAPGQGLEWMGRIIP MFGTSNYAQKFQGRVTITADGSTSTAYMELSSLRSEDTAVYYCARVGSPTTGAIMG VWGQGTTVTVSS | ADI-14343 | Heavy chain variable region ("HC") amino acid sequence |
| Ab 11 | 22 | DIVLTQTPLSLPVTPGEPASISCRSSQSLLQSNGFNYLDWYLQKPGQSPKLLIYMGSN RASGVPDRFSGSGSGTDFTLLIISRVEAEDVGVYYCMQAIESPLTFGGGTKVDIK | ADI-14343 | Light chain variable region ("LC") amino acid sequence |
| Ab 12 | 23 | QVQLVQSGGGLVQPGGSLRLSCAASGFTFRTYALSWVRQAPGKGLEWVSSIILGSG GSTYYADSVKGRFTISRDNSKNTLYLQLNSLRAEDTAVYFCAKLAVAGLLHHYYGLD VWGQGTTVTVSS | ADI-14344 | Heavy chain variable region ("HC") amino acid sequence |
| Ab 12 | 24 | SYELTQPPSVSVSPGQTASITCSGDKLENKYACWYQQKPGQSPVLLIYQDTKRPSGI PERFSGSNSGTTATLTISGTQALDEADYYCQAWDSSTASVLFGGGTQLTVL | ADI-14344 | Light chain variable region ("LC") amino acid sequence |
| Ab 13 | 25 | QITLKESGAEVKKPGASVKVSCKVSGYTLSDFSMHWVRQAPGKGLEWMGSFDPE DGETVDAQKFQGRVTMTEDRSTATAYMELRSLRSEDTAVYYCGTPASAGQVDYW GQGTLVTVSS | ADI-14345 | Heavy chain variable region ("HC") amino acid sequence |
| Ab 13 | 26 | DIVLTQSPSSLSASVGDRVTITCRASQSISSYLHWYQQKPGKAPKLLIYAASSLQSGVP SRFSGSGSGTDFTLTISSLQPEDFATYYCQQSYITPYTFGQGTKLEIK | ADI-14345 | Light chain variable region ("LC") amino acid sequence |
| Ab 14 | 27 | EVQLLESGGGLVKPGGSLRLSCAASGFRFSSYSMNWVRQAPGKWLEMVSSISASSS YTDYADSVKGRPFTISRDNAKNSLYLQMNSLRAEDTAVYYCAREDYLSSGSLLHWFD PWGQGTLVTVSS | ADI-14346 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 14 | 28 | QPVLTQPPSVSGAPGQRVTISCTGSSSNIGAGYDVHWYQQLPGTAPKLLIYGNNNR PSGVPDRFSGSKSGTSASLAITGLQAEDEADYYCQSYDSRLSVLFGGGTKVTVL | ADI-14346 | Light chain variable region ("LC") amino acid sequence |
| Ab 15 | 29 | EVQLVESGGGLVKPGGSLRLSCAASGFTFRDYYMNWIRQAPGKGLEWVSDISASSS YTNYADSVKGRFTISRDNAKTSLYLQMNSLRAEDTAVYYCAREVVTAMGGYYFDY WGQGTLVTVSS | ADI-14347 | Heavy chain variable region ("HC") amino acid sequence |
| Ab 15 | 30 | QSVVTQPPSVSGAPGQRVTISCTGSSSNIGAGYDVHWYQQLPGTAPKLLIYGNNNN RPSGVPDRFSGSKSGTSASLAITGLQAEDEADYYCQSYDSSLSGSGVFGTGTKVTVL | ADI-14347 | Light chain variable region ("LC") amino acid sequence |
| Ab 16 | 31 | QVQLVESGGGVAQPGGSLRLSCVASGFTFSNYGMHWVRQAPGKGLEWVAFIRSD GSKKYYGDSGKGRFTISRDNSKNTLYLQMNSLRAEDTALYYCARERAGATFAFDIW GQGTTVTVSS | ADI-14348 | Heavy chain variable region ("HC") amino acid sequence |
| Ab 16 | 32 | QSALTQPRSVSGSPGQSVTISCTGTSSDVGGYNFVSWYQHPGKAPKLMIYDVTN RPSGVPDRFSGSKSGNTASLTISGLQADDEADYYCCSYAGGFTFVVFGTGTKVTVL | ADI-14348 | Light chain variable region ("LC") amino acid sequence |
| Ab 17 | 33 | EVQLVESGAEVKKPGSSVKVSCKASGGTLSSYAFSWVRQAPGQGLEWMGGVIPIS ATSDYAQKFQGRVTITADESTSTVMELRSEDTAVYYCARDTRYSSGWFYDIW GQGTLVTVSS | ADI-14349 | Heavy chain variable region ("HC") amino acid sequence |
| Ab 17 | 34 | DIRLTQSPDSLAVSLGERATINCKSSQSVLYSSNNKNYLAWYQQKPGQPPNLLIYWA STRDGSVPDRFSGSGSGTDFTLTISRLQAEDVAVYYCQQYYSTPYTFGQGTKLEIK | ADI-14349 | Light chain variable region ("LC") amino acid sequence |
| Ab 18 | 35 | EVQLVESGPGLVKPSETLSLTCTVSGDSVSNNNYYWNWIRQSPGKGLEWIGYIYYS GSTDYNPSLKSRVTISVDTSKNQFSLNLRSVTAADTAIYFCASAPWGMFTLLGVVPSY YYGMDVWGQGTTVTVSS | ADI-14350 | Heavy chain variable region ("HC") amino acid sequence |
| Ab 18 | 36 | QSVLTQPPSVSGAPGQRVTISCTGSSSNIGAGYDVHWYQQLPGTAPKLLIYGSSNR PSGVPDRFSGSKSGTSASLAITGLQAEDEADYYCQSYDGSLGVYVFATGTKVTVL | ADI-14350 | Light chain variable region ("LC") amino acid sequence |
| Ab 19 | 37 | EVQLLESGGGLVQPGGSLRLSCSASGFTFSTYWMHWVRQAPGKGLVWVSRINGD GNDRNYADSVKGRFTIISRDNAKNTVTVLQMNSLRAEDTAVYYCARGGATGDFYFG MDVWGQGTTVTVSS | ADI-14351 | Heavy chain variable region ("HC") amino acid sequence |
| Ab 19 | 38 | SYELTQPPSVSVAPGKTAKITCGGNNIGTKSVHWYQQKPGQAPVLVIYYDDRPSGI PERFSGSNSGNTATLTISRVEAGDEADYYCQVWDSSNSDHVGVFGGGTQLTVL | ADI-14351 | Light chain variable region ("LC") amino acid sequence |
| Ab 20 | 39 | EVQLLETGPGLVKPSQTLSLLICAVSGGSISSGGYSWSWIRQPPGKGLEWVGYISYSG STYYNPSLKSRVTISVDTSKNQFSLKLNSVTAADTAVYFCARVDGIYSSGMRFDYWG QGTLVTVSS | ADI-14352 | Heavy chain variable region ("HC") amino acid sequence |
| Ab 20 | 40 | DIQLTQSPGTLSLSPGERATLSCRASQSVSSYYLAWYQQKPGQAPRLLIYGTSSRATG IPDRFSGSGSGTDFTLTISRLEPEDFAVYYCQQYGRSPLFGQGTRLEIK | ADI-14352 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 21 | 41 | QVQLVQSGAEVKKPGSSVKVSCKASGGTFSSYTISNVRQAPGQGLEWMGRIKPIIG IANNAQFKGRVTITAEKSTGTAYMELSSLTSEDTAVYYCARGGYDYYGMDVWGQ GTTVTVSS | ADI-14353 | Heavy chain variable region ("HC") amino acid sequence |
| Ab 21 | 42 | QSALTQPASVSGSPGQSITISCTGTSSDVGGYNYVSWHQQHPGKAPKLLIYDVSNR PSGVSNRFSGSKSGNTASLSISGLQAEDEADYYCSSFTSTSTPYVFGTGTQLTVL | ADI-14353 | Light chain variable region ("LC") amino acid sequence |
| Ab 22 | 43 | QVQLVQSGAEVKKPGSSAKVSCKASGGTFSSYTISWVRQAPGQGLEWMGRIIPFL GIANYAQKFQGRVTFTADKSTSTVYMDLSRLRSEDTALYYCAREPMYYGGDSYAFD VWGQGTTVTVSS | ADI-14354 | Heavy chain variable region ("HC") amino acid sequence |
| Ab 22 | 44 | QSVLTQPASMSGSPGHSITISCTGTSSDVGAYNYVSWYQQHPGKAPKLMIYDVSN RPSGVSSRFSGSKSGNTASLIISGLQPEDEADYYCSSFTTSSTRVEGTGTKLTVL | ADI-14354 | Light chain variable region ("LC") amino acid sequence |
| Ab 23 | 45 | EVQLVESGPTLVKPTQTLTLICTFSGFSLSTSGVGVGWIRQPPGKALEWLAVIYWD DDKTYSPSLKSRLTITIKDTSKNQVVLTMTNMNPVDTATYYCARCPAPVVGYGVDV WGQGTTVTVSS | ADI-14355 | Heavy chain variable region ("HC") amino acid sequence |
| Ab 23 | 46 | QSALTQPASVSGSPGQSITISCTATSSDFGGGYDYVSWYQQHPGEAPKLMISDVTNR PSGVSNRFSGSKSGNTASLTISGLQAEDEADYYCSSYTSYTTPYVFGTGTKLTVL | ADI-14355 | Light chain variable region ("LC") amino acid sequence |
| Ab 24 | 47 | QVQLQESGAGLLKPSETLSLTCAVYGGSFSGYYWSWIRQPPGKGLEWIGEINHSGS TNYNPSLKSRVTISVDTSKNQFSLKLSSVTAADTAVYYCARDQRIVVGAATEPYYY YGMDVWGQGTTVTVSS | ADI-14356 | Heavy chain variable region ("HC") amino acid sequence |
| Ab 24 | 48 | QPVLTQPPSVSVSPGQTARITCSGDALPKQYAYWYQQKPGQAPVLVLIYKDSERPSG IPERFSGSSSGTTVTLTISGVQAEDEADYYCQSADSSGTYRVFGGGKLTVL | ADI-14356 | Light chain variable region ("LC") amino acid sequence |
| Ab 25 | 49 | EVQLVESGGGVVQPGRSLRLSCAASGFTFSNYAMHWVRQAPGKGLEWVSIISYDG SNKYYADSVKGRFTISRDNSKNTLYLQINSLRTEDTAVYYCARARKRIPIVVTAPYYY GMDVWGQGTTVTVSS | ADI-14357 | Heavy chain variable region ("HC") amino acid sequence |
| Ab 25 | 50 | DIRVTQSPSSLSASVGDRVTITCRASQSISSYLHWYQQQPEDFATYYCQQSYTTPHTFGQGTKVEIK VPSRFSGSGSGTDFTLTISSLQPEDFATYYCQQSYTTPHTFGQGTKVEIK | ADI-14357 | Light chain variable region ("LC") amino acid sequence |
| Ab 26 | 51 | QVQLVQSGGGLVKPGGSLRLSCVASGFTFSDYYMTWIRQAPCKGLEWVSYISGSS AYTIYADSVKGRFTISRDNAKNSLYLQMNGLRAEDTAVYYCARVSWVRSLDSWGQ GTLVTVSS | ADI-14358 | Heavy chain variable region ("HC") amino acid sequence |
| Ab 26 | 52 | QSALTQPASVSGSPGQSITISCTGTSSDVGLLYNYVSWYQLHPGKAPKLLIYDVRHRPS GVSDRFSASKSGNTASLTISGLQAEDEADYYCCSSTTSSSTYVFGSGTQLTVL | ADI-14358 | Light chain variable region ("LC") amino acid sequence |
| Ab 27 | 53 | QVQLVQSGPALVKPTQTLTLTCFSGFSLSTSGMCVSWIRQPPGKALEWLARIDW DDDKYYSTSLKTRLTISKDTSKNQVVLTMTNMDPVDTATYYCARATNYDSSGYYSLY FDYWGQGTLVTVSS | ADI-14359 | Heavy chain variable region ("HC") amino acid sequence |
| Ab 27 | 54 | DIQMTQSPSSLSASVGDRVTITCRASQSISSYLNWYQQKPGKAPKLLIYAASSLQSG VPSRFSGSGSGTDFTLTISSLQPEDFATYYCQQSYSTPYTFGQGTKVEIK | ADI-14359 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 28 | 55 | QVQLVQSGAEVKKPGASVKVSCKASGTFTFTYSMHWVRQAPGQRLEWMGWIN AGNGNTKYSQKFQGRVTITRDTSASTAYMELSSLRSEDTAVYYCARDGVGGAYYYG EMDVWGQGTTVTVSS | ADI-14360 | Heavy chain variable region ("HC") amino acid sequence |
| Ab 28 | 56 | EIVLTQSPLSLPVTPGEPASISCRSSQSLLHSNGYNYLDWYLQKPGQSPQLLIYLGSNR ASGVPDRFSGSGSGTDFTLKISRVEAEDVGVYYCMQALQTPRFTFGPGTKVEIK | ADI-14360 | Light chain variable region ("LC") amino acid sequence |
| Ab 29 | 57 | EVQLLESGGGFVQPGGSLRLSCAASGFTFSSYAVNWVRQAPGKGLEWVSLISGSGR TDYTDSVKGRFTISRDNAKNTLFLQMNSLRVEDTAVYYCAKSWGSSGYGYLDYWG QGTLVTVSS | ADI-14361 | Heavy chain variable region ("HC") amino acid sequence |
| Ab 29 | 58 | QSGLTQPPSVSGAPGQRVTISCTGSSSNIGPGTDVHWYQHFPGTAPKLLIFGNSNR PSGVPDRFSGSKSGTSASLAITGLQAEDEAYYYCQSYDRILSASVPGGGTKLTVL | ADI-14361 | Light chain variable region ("LC") amino acid sequence |
| Ab 30 | 59 | EVQLLESGGGLVQPGGSLRLSCAASGFTFSSYAMSWVRQAPGKGLEWVSGISGSG GSTYYADSVKGRFTISRDNSKNTLYLEMNSLRAEDTAVYYCAKRYYYGSGTYTFDIW GQGTMVTVSS | ADI-14362 | Heavy chain variable region ("HC") amino acid sequence |
| Ab 30 | 60 | DIRLTQSPSSLSASVGDRVTITCRASQSIISYLNWYQQKPGKAPKLLIYAASSLQSGVP SRFSGSGSGTDFTLTISSLQPEDFATYYCQQSYSTPYTFGQGTKVEIK | ADI-14362 | Light chain variable region ("LC") amino acid sequence |
| Ab 31 | 61 | QVQLVESGGGLVKPGGSLRLSCAASGFTFSDYYMSWIRQAPGKGLEWVSYISGGG TYTKYADSVKGRFTISRDNAKNSVVLQMNSLRAEDTAVYYCARDVALVGWELRYG MDVWGQGTTVTVSS | ADI-14363 | Heavy chain variable region ("HC") amino acid sequence |
| Ab 31 | 62 | ETTLTQSPGTLSLSPGERATLSCRARENVNSSYLAWYQQKPGQAPRLLIYGASSRAT GIPDRFSGSGSGTDFTLTISRLEPEDFAVYYCQQYAISPWTFGQGTKVEIK | ADI-14363 | Light chain variable region ("LC") amino acid sequence |
| Ab 32 | 63 | QVQLVQSGAEVKKPGESLKISCKGSGYSFTSHWIGWVRQMPGKGLEWMGIIDPG DSDTRYSPSFQGQVTISADKSISTAYLQWSLKASDTAMYYCAREPRRWMTETNG PYYFDNWGQGTLVTVSS | ADI-14364 | Heavy chain variable region ("HC") amino acid sequence |
| Ab 32 | 64 | SYVLTQPPSVSVAPGKTARIITCGGNNIGSKSVHWYQQKPGQAPVLVIYDDSDRPSGI PERFSGSNSGNTATLTISRVEAGDEADYYCQVWDSSSDNRVFGGGTKVTVL | ADI-14364 | Light chain variable region ("LC") amino acid sequence |
| Ab 33 | 65 | QVQLVQSGAEVKKPGASVKVSCKVSGYTLTKLSMHWVRQAPGKGLEWMGFDP EDGDTLYAQKFQGRVTMTEDTSSDTPYMELRSEDTAVYYCASPAAAGQFDYW GQGTLVTVSS | ADI-14365 | Heavy chain variable region ("HC") amino acid sequence |
| Ab 33 | 66 | DIVMTQSPSSLSASVGDRVTITCRASQFISSYLHWYQQKTGKAPKLLIYAASSLQSGV PSRFSGSGSGTDFTLTISSLQPEDFATYYCQQSYNTPRTFGQGTKLEIK | ADI-14365 | Light chain variable region ("LC") amino acid sequence |
| Ab 34 | 67 | QVQLVQSGTEVKKPGASVKVSCKASGYTFNMYGVSWVRQAPGQGLEWMGWIS AYNGNTNYAQKFQGRVTMTIDTSTTTAYMELRSDDTAMYYCARDPAEEPLS NWFDPWGQGTLVTVSS | ADI-14366 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 34 | 68 | DIVMTQTPSSLSASVGDRVIITCRASQSISRYINWYQKKPGKAPKFLIYAVSSLGSGVP SRFSGSGSGTDFTLTISSLQPEDFATYYCQQSYSTPFTFGPGTKVDIK | ADI-14366 | Light chain variable region ("LC") amino acid sequence |
| Ab 35 | 69 | EVQLLESGGGLVQPGGSLRLSCAASGFTFGSYDMNWVRQAPGKGLEWVSGISGS GDATYYADSVKGRFTISRDNSKNMLYLQMNSLSAEDMAVYYCARDRAFTMKYNS NWYKIYWGQGTMVTVSS | ADI-14367 | Heavy chain variable region ("HC") amino acid sequence |
| Ab 35 | 70 | EIVLTQSPGTLSLSPGERATLSCRASQSVTSSYLAWYQQKPGQAPRLLIYGAFSRATG IPDRFSGSGSGTDFTLTISRLEPEDFAVYYCHHYGISRWTFGQGTKVDIK | ADI-14367 | Light chain variable region ("LC") amino acid sequence |
| Ab 36 | 71 | EVQLVESGGGLVKPGGSLRLSCAASGFTFINAWMSWVRQAPGCKGLEWVGRIKSK ADGGTTDDAAPVKGRFTISRDDSKNTLYLQMNSLKIEDTAVYYCATDVLPLYNWNL GWNFDLWGRGTLVTVSS | ADI-14368 | Heavy chain variable region ("HC") amino acid sequence |
| Ab 36 | 72 | SYVLTQPPSVSVAPGKTARITCGGNNIADKSVHWYQQKPGQAPVLVMYDTDRPS GIPERFSGFNSGNTATLTISRVEAGDEADYYCQVWDSSSDHVFGGGTKVTVL | ADI-14368 | Light chain variable region ("LC") amino acid sequence |
| Ab 37 | 73 | QVQLVQSGAEVKKPGSSVKVSCKASGFTFSSNAISWVRQAPGQGLEWMGGIIPIF ATANYAQNFQDRVTITADESTGTAYMELSSLRYEDTAVYYCAKSAIHSGYHGPARS GFYQNGMDVWGQGTTVTVSS | ADI-14369 | Heavy chain variable region ("HC") amino acid sequence |
| Ab 37 | 74 | SYELTQPPSASGTPGQRVTISCSGSSSNIGINPVNMYNHPPGTAPKLLIYRNNQRPS GVPDRFSGSKSGTSASLAISGLQSEDEAVYYCAAWDDRLNGPVFGGGTQLTVL | ADI-14369 | Light chain variable region ("LC") amino acid sequence |
| Ab 38 | 75 | EVQLVESGGGLVQPGKSLRLSCAASGFTFSSYAMHWVRQAPGKGLEWVAVISYD GSNKFYADSVKGRFTISRDDSKNTLYLQMNSLRAEDTAVYYCARGGYSSGWYVTHF DYWGQGTLVTVSS | ADI-14370 | Heavy chain variable region ("HC") amino acid sequence |
| Ab 38 | 76 | QSVLTQPPSASGSPGQSVTISCTGTSSDVGGYNYVSWYQQHPGKAPKLMIYEVSKR PSGVPDRFSGSKSGNTASLIVSGLQAEDEADYYCSSYAGSNNLYVEGTGTKLTVL | ADI-14370 | Light chain variable region ("LC") amino acid sequence |
| Ab 39 | 77 | EVQLVESGGGLVQPGGSLRLSCAASGFTFSNYAMTWVRQAPGKGLEWLSSISGSG GSTYYADSVKGRFTISRDNSRNTLVVQMNSLRVEDTAFYYCAKAFYEYGAGSPGDY WGQGTLVTVSS | ADI-14371 | Heavy chain variable region ("HC") amino acid sequence |
| Ab 39 | 78 | DIQLTQSPSSLSASVGDRVTITCRASQSIGTNLNWYQQKPGKAPKFLIYAASSLQRG VPSRFSGSGSGSEFTLTISSLQPEDFATYYCQQSYSTLPITFGQGTKLEIK | ADI-14371 | Light chain variable region ("LC") amino acid sequence |
| Ab 40 | 79 | QVQLVESGGGLVQPGGSLRLSCAASGFTFSNYAMGWVRQAPGQGLEWVSRISAT GGSTHYADSVRGRFTISRDNSKNTLYLQMNSLKAEDTAVYYCAKDRGYSRNLTPDY WGQGTLVTVSS | ADI-14372 | Heavy chain variable region ("HC") amino acid sequence |
| Ab 40 | 80 | ETTLTQSPSSLSASVGDRVTITCRASQGITNDLGWYQKKPGKAPKFLIYASSLQSGV PSRFSGSGSGTDFTLTISSLQPEDFATYYCLQDYNYPITFGGGTKVDIK | ADI-14372 | Light chain variable region ("LC") amino acid sequence |
| Ab 41 | 81 | QVQLQQWGAGLLKPSETLSLTCAVYGGSFSGSYWSWIRQPPGKGLEWIGEINHSG STSYNPSLKSRVTISVDTSKKQFSLKLSSMTAADTAVYYCAGGFYDSSGSYAPHPTF DYWGQGTLVTVSS | ADI-14373 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 41 | 82 | DIVMTQTPATLSVSPGERATLSCRASQSVSSNLAWYQQKPGQAPRLLIYGASTRAT GIPARFSGSGSGTEFTLTISSLQSEDFAVYYCQQYNNWPRTFGQGTKVEIK | ADI-14373 | Light chain variable region ("LC") amino acid sequence |
| Ab 42 | 83 | QVQLVQSGGVVVQPGGSLRLSCAASGFNFDDFTMHWVRQAPGKGLEWVSLITW DGGITYYADSVKGRFTISRDNGKNSLYLRMNSLRTEDTALYYCAKDGDRYGYAFLD YWGQGTLVTVSS | ADI-14374 | Heavy chain variable region ("HC") amino acid sequence |
| Ab 42 | 84 | SYELTQPPSVSVAPGKTARLITCGGNNIGSESVHWYQQRPGQAPVLVSYYNGDRPS GIAERISASKSGNTATLTIYRVEAGDEADYYCQVWHSSSDHFVFGTGTQLTVL | ADI-14374 | Light chain variable region ("LC") amino acid sequence |
| Ab 43 | 85 | EVQLVESGGGLVQPGGSLRLSCAVSGFTFSNYAVSWVRQAPGKGLEWVSGISGSG GTTYYVDSVKGRFTVSRDNSKNTLFLQLNSLKAEDTAVYYCAKDWGYSGGRPYFDY WGQGTLVTVSS | ADI-14375 | Heavy chain variable region ("HC") amino acid sequence |
| Ab 43 | 86 | QSVLTQPPSVSGAPGQRVTISCTASSSNIGPIYDVHWYQQLPGTGPKLLIYGNNNRP SGVPDRFSGSKSGTSASLAITGLQAEDEADYYCQSYDTSLSVVFGGGTKLTVL | ADI-14375 | Light chain variable region ("LC") amino acid sequence |
| Ab 44 | 87 | EVQLVESGGGLVQPGGSLRLSCAASGFTFSSYWMHWVRQAPGKGLEWVSRINSD GSTTNYADYMKGRFTISRDNAKNTVYLQMNSLRAEDTAVYYCARDSDSYDDAFDI WGQGTTVTVSS | ADI-14376 | Heavy chain variable region ("HC") amino acid sequence |
| Ab 44 | 88 | SYELTQPPSVSVSPGQTARISCSGEALPKKYSWYQQKSGQAPVLVIYEDSKRPSGIP ERFSGSSSGTMATLTISGAQVEDEADYYCYSTDSSGNHRVFGGGTKVTVL | ADI-14376 | Light chain variable region ("LC") amino acid sequence |
| Ab 45 | 89 | EVQLVESGGGVVQPGGSLRLSCAVSGITFSSYGMHWVRQAPGKGLEWVAFIRYD GSNKYYGDSLRGRFTISRDNSKNTLYLQMNSLRAEDTAVYYCAKDAVGIGGYYGLD VWGQGTTVTVSS | ADI-14377 | Heavy chain variable region ("HC") amino acid sequence |
| Ab 45 | 90 | DIQMTQSPSSLSASVGDRVTITCRASQGIRNDLGWYQQKPGKAPKRLIYAASSLQS GVPSRFSGSGSGTEFTLTISSLQPEDFATYYCLQHNGYPWTFGQGTKVEIK | ADI-14377 | Light chain variable region ("LC") amino acid sequence |
| Ab 46 | 91 | QVQLVESGGGLVQPGGSLRLSCAASGFTFSSYWMHWVRQAPGKGLVWVSRINS DGSSPTYADSVKGRFTISRDNAKNTVFLQMNSLRAEDTAVYYCARESWELIRGDAF DIWGQGTTVTVSS | ADI-14378 | Heavy chain variable region ("HC") amino acid sequence |
| Ab 46 | 92 | DIQMTQSPSSLSASVGDRVTITCRASQSISSSLNWYQQKPGKAPNLLIYAASTLQSG VPSRFSGSGSGTDFTLTISSLQPEDFATYYCQQSYRTPRTFGQGTKVEIK | ADI-14378 | Light chain variable region ("LC") amino acid sequence |
| Ab 47 | 93 | EVQLLESGGGVVQPGRSLRLSCAASGFTFSSYAMHWVRQAPGKGLEWVAVIGND GTNKYHADSVKGRFTISRDNSKNTLYLQMNSLRAEDTAVYYCARRRVGIMYSGSY WGGMDVWGQGTTVTVSS | ADI-14379 | Heavy chain variable region ("HC") amino acid sequence |
| Ab 47 | 94 | SYELTQPPSVSVSPGQTASITCSGDKLGGKVSWYQQKPGQSPVLVMYQDTRRPS GIPERLSGSNSGSTATLTISATQAMDEADYYCQAWDITTVHVFGGGTKLTVL | ADI-14379 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 48 | 95 | QVQLVQSGAEVKKPGESLKISCKGSGYTFTSYWIGWVRQLPGKGLEMMGVIFPGD SDTRYSPSFQGQVTISADKSISTAYLQWSSLKAADTAMYYCARTRLGRGFYRFDSW GQGTLVTVSS | ADI-14380 | Heavy chain variable region ("HC") amino acid sequence |
| Ab 48 | 96 | QSVLTQPPSVSAAPGQKVTISCSGSSSNIGNNYVSWYQQLPGTAPRLLIYENNERPS GIPDRFSGSKSGTSATLGITGLQTGDEADYYCATWDSGLSAGYVFGTKLTVL | ADI-14380 | Light chain variable region ("LC") amino acid sequence |
| Ab 49 | 97 | EVQLVESGGGLVQPGGSLRLSCAASGFTFSSYSMNWVRQAPGKGLEWVSTIGSSS SSVYYGDSAKGRFTISRDNAKNSLYLQMNSLRDEDTALYYCARVGWLQYCRGGSCY ASFGMDVWGQGTTVTVSS | ADI-14381 | Heavy chain variable region ("HC") amino acid sequence |
| Ab 49 | 98 | DIQMTQSPSSLSASVGDRVTITCRASQGIRNDLGWYQQKPGIAPKLLIYAASSLQSG VPSRFSGSGSGTDFTLTISSLQPEDFATYYCLQDYDSPYIFGQGTKLEIK | ADI-14381 | Light chain variable region ("LC") amino acid sequence |
| Ab 50 | 99 | EVQLLESGGGVVQPGRSLRLSCAASGFTFSAYGFHNVRQAPGCKGLEMVAVIWFD GNNKYYADSMKGRFIISRDNSKNTLYLQMNSLRAEDTAVYYCARDPKETGEFDYW GQGTLVTVSS | ADI-14382 | Heavy chain variable region ("HC") amino acid sequence |
| Ab 50 | 100 | QSALTQPASVSGSPGQSITISCTGTISDVGRYNYVSWYQQHPGKAPKLMIYDVTNR PSGVSNRFSGSKSGNTASLTISGLQAEDEAVYYCCSYTISSTYVFGTGTKLTVL | ADI-14382 | Light chain variable region ("LC") amino acid sequence |
| Ab 51 | 101 | QITLKESGPTLVKPTQTLTLTCTFSGFSLSTSGVGVGWIRQPPGKALEWLALIYWDE DKRYSPSLKTRLTITKDTSRNQVKLIMTNMDPVDTATYYCAHQYYDILTGYPSPGAF DIWGQGTTVTVSS | ADI-14383 | Heavy chain variable region ("HC") amino acid sequence |
| Ab 51 | 102 | QPVLTQPASVSGSPGQSITISCTGTSSDVVSNLVSWFQQHPGKAPKLMIYEVTRRP SGVSNRFSGSKSGNTASLTISGLQAEDEADYYCCAYTGTPVVFGGGTKLTVL | ADI-14383 | Light chain variable region ("LC") amino acid sequence |
| Ab 52 | 103 | QVQLQESGSGLVKPSQTLSLTCTVSGGSISSGVGYSMSWIRQPPGKGLEWIGYIYHSG SPYYSPSLNSRVTISVDRSKNQFSLKLSSVTAADTAVYFCARVFFGGGGAPDIWGQG TTVTVSS | ADI-14384 | Heavy chain variable region ("HC") amino acid sequence |
| Ab 52 | 104 | QPGLTQPPSVSVAPGQTARITCGGNNIGSKSVQWYQQKPGQAPVLVMYYDSDRP SGIPDRFSGSSSGNTATLTITRVEAGDEADYSCQVNDSVNVHPVIFGGGTKLTVL | ADI-14384 | Light chain variable region ("LC") amino acid sequence |
| Ab 53 | 105 | QVQLVQSGAEVKKPGESLKISCKGSGYFTSYWIGWVRQMPGCKGLEMMGIIYPGD SDTRYSPSFQGQVTISADKSISTAYLQWSSLKASDTAMYYCASSSYSNYFDYWGQG TLVTVSS | ADI-14385 | Heavy chain variable region ("HC") amino acid sequence |
| Ab 53 | 106 | NFMLTQPHSVSESPGKTVTISCTRSSGSIASNYVQWVQQRPGSAPTTVIYEDNQRP SGVPDRFSGSIDSSSNSASLTISGLKTEDEADYYCQSYDSSNPWVFGGGTKLTVL | ADI-14385 | Light chain variable region ("LC") amino acid sequence |
| Ab 54 | 107 | EVQLVESGGGLVQPGGSLRLSCAASRFTFSSYAMSWVRQAPGKGLEMVSGIGASG GTTYYADSVKGRFTISRDNSKNTVYLQMNSLRAEDTAVYYCARCEYYGSSAGYYF DYWGQGTLVTVSS | ADI-14386 | Heavy chain variable region ("HC") amino acid sequence |
| Ab 54 | 108 | SYELTQPPSVSVPGQTASITCSGDKLGSKFAFWYQQKPGQSPVLVIFQDVKRPSGI PERFSGSNSGNTATLTISGTQAMDEADYYCQAWDSGTAVFGGGTKVTVL | ADI-14386 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 55 | 109 | EVQLVESGGGVVQPGRSLRLSCAASGFTFSSYPMHWVRQAPGKGLEWVAVISYD GSNKYYADSVKGRFTISRDNSKNTLYLQMNSLRAEDTAVYYSCARAQSAAIFDHWG QGTLVTVSS | ADI-14388 | Heavy chain variable region ("HC") amino acid sequence |
| Ab 55 | 110 | QAVVTQEPSLTVSPGGTVTLTCASSTGAVTSGYYPNWFQQKPGQAPRALIYTTSKR HSWTPARFSGSLLGGKAALTLSGVQPEDEADYYCLLYYGGANWVFGGGTKLTVL | ADI-14388 | Light chain variable region ("LC") amino acid sequence |
| Ab 56 | 111 | EVQLVESGGGLVKPGGSLRLSCAASGFTFINAWMAWVRQAPGKGPEWVGRIKSR ADGGTTDYAAPVKGRFTISRDDSKNRLFLQMDSLKTDDTAVYFCTTGVRALRFYNG MDVWGQGTTVTVSS | ADI-14389 | Heavy chain variable region ("HC") amino acid sequence |
| Ab 56 | 112 | ETTLTQSPSSLSASIGDRVTITCRAQQSISSFLNWYQQKPGKAPKLLIYAASTLQSGVP SRFSGSKSGTDFTLTISSLQPEDFATYYCQQSYHTFTFGPGTKVEIK | ADI-14389 | Light chain variable region ("LC") amino acid sequence |
| Ab 57 | 113 | QVQLVESGPGLVKPSETLSLTCAVSGYSISSGYYWGWIRQPPGKGLEWIGNIYHSGS TYYNPSLKSRVTISVDTSKNQFSLKLSSVTAADTAVYYCARATLRFTLVREVVVTACD AFDIWGQGTTVTVSS | ADI-14390 | Heavy chain variable region ("HC") amino acid sequence |
| Ab 57 | 114 | QSALTQPASVSGSPGQSITISCTGTSSDVGSYNLVSWYQQHPGKVPKLVIYEVNKRP SGVSNRFSGSKSGNTASLTISGLQAEDEADYYCCSYAGSSTFVVEGGGTKLTVL | ADI-14390 | Light chain variable region ("LC") amino acid sequence |
| Ab 58 | 115 | QVQLVESGGGLVKPGGSLRLSCAAAGFTFSSNYAMSWVRQAPGKGLEWVAVISGN AGSTYYAESVKGRFTISRDNSKNTLHLQMNSLRGEDTAVYYCAKPPGIAVAGEYYW YFDLWGRGTLVTVSS | ADI-14391 | Heavy chain variable region ("HC") amino acid sequence |
| Ab 58 | 116 | QVQLMQPPSVSVSPGQTARITCSGDALPRENAYWYQQKSGQAPVLVIYEDSKRPS GIPERFSGSSSGTMATLTITGAQVEDEADYYCYSTDTSAYHWVFGGGTKLTVL | ADI-14391 | Light chain variable region ("LC") amino acid sequence |
| Ab 59 | 117 | EVQLLESGAEVKKPGSSVKVSCKASGGTFSSYGISWVRQAPGQGLEWMGGIIPIFG TSNYAQKFQGRVTITADESTSTAYMELSSLRSEDTAVYYCALDSSGRARYYAMDVW GQGTTVTVSS | ADI-14392 | Heavy chain variable region ("HC") amino acid sequence |
| Ab 59 | 118 | DIQVTQSPATLSLSPGERATLSCRASQSVSSYLAWYQQKPGQAPRLLIYDASNRATG IPARFSGSGSGTDFTLTISSLEPEDFAVYYCQQRNNWPPTFGPGTKVEIK | ADI-14392 | Light chain variable region ("LC") amino acid sequence |
| Ab 60 | 119 | QVQLVESGGGLVKPGGSLRLSCAASGFSFTGFYMNWVRQAPGKGLEWVSISSSS TYKNYADSLQGRFTISRDNARSSLYLQMNSLRAEDTAVYYCARTRTEYTYGYYHDF WGQGTLVTVSS | ADI-14393 | Heavy chain variable region ("HC") amino acid sequence |
| Ab 60 | 120 | QPVLTQPPSVSGAPGQRVTISCTGSSNIGAGYDVHWYQQVPGTAPKLLIYNNNN RPSGVPDRFSGSKSGTSASLAITGLQAEDEADYYCQSYDSRLSGVPGGGTKLTVL | ADI-14393 | Light chain variable region ("LC") amino acid sequence |
| Ab 61 | 121 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCARGSEYYFDIWGQGTL VTVSS | ADI-14394 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 61 | 122 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSVVEGGTKVTVL | ADI-14394 | Light chain variable region ("LC") amino acid sequence |
| Ab 62 | 123 | EVQLVESGGGVVQPGRSLRLSCAASGFTFSSYAMHWVRQAPGKGLEWVAISYD GSNKYYADSVKGRFTISRDNSKNTLYLQMNSLRAEDTAVYYCARDDTYYDSSGYS APFDYWGQGTLVTVSS | ADI-14395 | Heavy chain variable region ("HC") amino acid sequence |
| Ab 62 | 124 | DIQVTQSPSTLSASVGDRVTITCRASQSISSWLAWYQQKPGKAPKLLIYKASSLESGV PSRFSGSGSGTEFTLTISSLQPDDFATYYCQQYNSYPWTFGQGTKVEIK | ADI-14395 | Light chain variable region ("LC") amino acid sequence |
| Ab 63 | 125 | EVQLVESGGGVVQPGRSLRLSCAASGFTFSSYAMHWVRQAPGKGLEWVAILSYD GSNKYYADSVKGRFTISRDNSKNTLYLQMNSLRAEDTAVYYCARELRYFDWEYGG MDVWGQGTTVTVSS | ADI-14396 | Heavy chain variable region ("HC") amino acid sequence |
| Ab 63 | 126 | EIVLTQSPSSLSASVGDRVTITCQASQDISNYLNWYQQKPGKAPKLLIYDASNLETGV PSRFSGSGSGTDFTFTISSLQPEDIATYYCQQYDNLPMYTFGQGTKLEIK | ADI-14396 | Light chain variable region ("LC") amino acid sequence |
| Ab 64 | 127 | EVQLVESGGGVVQPGRSLRLSCAASGFTFSSYAMHWVRQAPGKGLEWVAISYD GSNKYYADSVKGRFTISRDNSKNTLYLQMNSLRAEDTAVYYCARDDTYYDSNGYS APFDYWGQGTLVTVSS | ADI-14397 | Heavy chain variable region ("HC") amino acid sequence |
| Ab 64 | 128 | DIQVTQSPSTLSASVGDRVTITCRASQSISSWLAWYQQKPGKAPKLLIYKASSLESGV PSRFSGSGSGTEFTLTISSLQPDDFATYYCQQYNSYPWTFGQGTKVDIK | ADI-14397 | Light chain variable region ("LC") amino acid sequence |
| Ab 65 | 129 | EVQLLESGPGLVKPSQTLSLTCAVSGGSINSGRYSWNWIRQPPGKGLEWIGYIYYSG TTYYNPSLESRVTISRDTSKNQFSLNLSSVTAADTAVYYCARTNSADSYASGSHYIRP QYFDFWGQGTLVTVSS | ADI-14399 | Heavy chain variable region ("HC") amino acid sequence |
| Ab 65 | 130 | DIQLTQSPATLSLSPGERATLSCRASQSVSSYLAWYQQKPGQAPRLLIYGASNRATGI PARFSGSGSGTDFTLTISRLEPEDFAVYYCQQRSNWLTFGGGTKVEIK | ADI-14399 | Light chain variable region ("LC") amino acid sequence |
| Ab 66 | 131 | QVQLVQSGGGVVQPGRSLRLSSAASGFTFSSYAMHWVRQAPGKGLEWVAISHD GSKYYADSVKGRFTISRDNSKSTLNLQMNSLRPEDTAVYYCARGGDVRLYDDSNGY HYDTYYFDYWGQGTLVTVSS | ADI-14400 | Heavy chain variable region ("HC") amino acid sequence |
| Ab 66 | 132 | EIVLTQSPSSLSASVGDRVTITCRASQGIRNDLGWYQQKPGKAPKLLIYAASTLQSGV PSRFSGSGSGTDFTLTISSLQPEDFATYYCLQDYNYPLTFGGGTKVEIK | ADI-14400 | Light chain variable region ("LC") amino acid sequence |
| Ab 67 | 133 | QVQLVQSGGGLVKPGGSLRLSCAASGFTFSSYAMHWVRQAPGKGLEWVSSISASS SYLNLAYADSVKGRFTISRDNAKKSLYLQLNTLRADDTAVYYCAREDHDSGTYLNWF DPWGQGTLVTVSS | ADI-14401 | Heavy chain variable region ("HC") amino acid sequence |
| Ab 67 | 134 | QSVVTQPPSVSGAPGQRVTISCTGSSSNIGAGYDVHWYQQFPGTGPKLLIYGNSHR PSGVPDRFSGSKSGPSASLAITGLQAEDEADYYCQSYDSSLSGYVFGTGTKVTVL | ADI-14401 | Light chain variable region ("LC") amino acid sequence |
| Ab 68 | 135 | QVQLVQSGAEVKKPGASVKVSCKTSGYTFTNYGISWVRQAPGQGLEMMGWISAY NGNRNYAQKLQGRVTMTTDTSTSTAYMELRSLRSDDTAVYYCAREPPVIAAGDFS HWGQGTLVTVSS | ADI-14402 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 68 | 136 | EIVLTQSPLSLPVTLGQPASISCRSSQSLVHSDANTYLSWFQQRPGQSPRRLIYKVSN RDSGVPDRFSGSGSGTDFTLKISRVEAEDVGVYYCMQGTHWPPDFGQGTRLEIK | ADI-14402 | Light chain variable region ("LC") amino acid sequence |
| Ab 69 | 137 | QVQLVESGGGLGKPGGSLRLSCAASGFTFSGYYMSWIRQAPGKGLEWVSDISSGSS FTNYADSVKGRFTISRDNAKNSLYLQMNSLKAEDTAVYYCARVPDSYGSGSYSGD SWGQGTLVTVSS | ADI-14403 | Heavy chain variable region ("HC") amino acid sequence |
| Ab 69 | 138 | QSVVTQPPSVSGAPGQRVTISCTGSSNIGAGYGVHWYQQLPGTAPKLLIYGNTNR PSGVPDRISGSKSGTSASLVITGLQAEDEADYYCQSYDSSLSGWVPFGGGTKLTVL | ADI-14403 | Light chain variable region ("LC") amino acid sequence |
| Ab 70 | 139 | EVQLVESGGGLVQPGGSLRLSCAASGFTFSNFEMNWVRQAPGKGLEWVSYISSSG RIIYYADSVKGRFTISRDNARNSLYVQMNSLRVEDTAVYYCARAKAAAGHDLWGQ GTLVTVSS | ADI-14404 | Heavy chain variable region ("HC") amino acid sequence |
| Ab 70 | 140 | EIVLTQSPSTLSASVGDRVTITCRASQSISPWLAWYQQKPGKAPKLLIYRASSLESGV PSRFSGSGSGTEFTLTISSLQPDDFATYYCQHYNSLYLYTFGQGTKVEIK | ADI-14404 | Light chain variable region ("LC") amino acid sequence |
| Ab 71 | 141 | QVQLVQSGTEVKKPGASVKVSCKASGYTFTNYDISWVRQAPGQGLEWMGWISGS TGNTIYAQNLQGRLTMTTDTSTSTAVMELRSLRSDDTAIYYCARDNVGYASGNYFD YWGQGTLVTVSS | ADI-14405 | Heavy chain variable region ("HC") amino acid sequence |
| Ab 71 | 142 | SYVLTQPPSVSVAPGKTARIPCGGNNIGSKSVHWYQQRPGQAPVLVIYDSVRPSG IPERFSGSNSGNTATLTISTVEAGDEADFYCQVWDSSRDHEVFGGGTKLTVL | ADI-14405 | Light chain variable region ("LC") amino acid sequence |
| Ab 72 | 143 | QVQLVQSGAEVKKPGSSLKISCKGSGYKFTNYWIAWVRQMPGKGLEWLGVIYPGA SDITYSPSFQGQVTISADKSISTAYLQWSSLKASDTAIYYCARQGSITAMSYWGQGT MVTVSS | ADI-14406 | Heavy chain variable region ("HC") amino acid sequence |
| Ab 72 | 144 | DIVMTQSPLSLPVTPGEPASISCRSSQSLLHSNGFNYLDWYLQKPGQSPQLLIYLGSN RASGVPDRFSGSGSGTDFTLKISRVEAEDVGVYYCMQALQTPFTFGPGTKVEIK | ADI-14406 | Light chain variable region ("LC") amino acid sequence |
| Ab 73 | 145 | QVQLVQSGGGVVQPGRSLRLSCAASGFTFSSYGMHWVRQAPGKGLEWVAVIWF DGNNKEYADSVKGRFAISRDNSKNTLYLQMNSLRAEDTAVYYCARDLIPVTIFGVV NPYSYYGMDVWGQGTTVTSS | ADI-14407 | Heavy chain variable region ("HC") amino acid sequence |
| Ab 73 | 146 | EIVMTQSPSSLSASVGDRVTITCRASQSISTYLNWYQQKPGTAPKLLIYAASSLESGV PSRLSGSGSGTEFILTISSLQREDFATYYCQQSYSTPPTFGQGTKVEIK | ADI-14407 | Light chain variable region ("LC") amino acid sequence |
| Ab 74 | 147 | QVQLVQSGPAILVKITQTLTLTCTFSGFSLITSGMCVSWIRQPPGKALEWLARIDW DDDKYSTSLKTRLTISKDTSKNQVVLTLTNVDPVDTATYYCARMQKYDSSGYYLHY FDSWGQGTLVTVSS | ADI-14408 | Heavy chain variable region ("HC") amino acid sequence |
| Ab 74 | 148 | DIRLTQSPSSLSASVGDRVTIACRASQSISSYLNWYQQKPGKSPKVLIYAASILQTGVP SRFSGSGSGTDFTLTISSLQPEDFATYYCQQSYSINQYTFGQGTKVEIK | ADI-14408 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 75 | 149 | QVQLVQSGGEVKKPGASVKVSCKASGYTFTYGISNVRQAPGQGLEWMGWISAY NGNTNYEQKFQGRVTMTDTSTGTAYMELRSLTSDDTAVYYCARDRIVVVTAANY YGLDVWGQGTTVTVSS | ADI-14409 | Heavy chain variable region ("HC") amino acid sequence |
| Ab 75 | 150 | DIQLTQSPDSLAVSLGERATINCKSSQSVLYRPNNKNFLAWYQQKPGQPPKLLIYW ASTRQSVPDRFSGSGSGTDFLTISSLQAEDVAVYYCQQYHTTPLTFGGGTKVDIK | ADI-14409 | Light chain variable region ("LC") amino acid sequence |
| Ab 76 | 151 | QVQLQQWGAGLLKPSETLSLLCAIYSGSFSGYYWSWIRQPPGKGLEWIGQINYSGS AYYTPSLKSRVTISVDTSKNQFSLKLSSVTAADTAVYYCARVRITMVQGAIVPCAIDV WGQGTTVTVSS | ADI-14410 | Heavy chain variable region ("HC") amino acid sequence |
| Ab 76 | 152 | SYELTQPPSASGTPGQRVTISCSGSSNIESNFVYNYQQLPGTAPKLLIHRNDQRPS GVPDRFSGSKSGTSASLAISGLRSEDEADYCAAWDDSLSGVVFGGGTKVTVL | ADI-14410 | Light chain variable region ("LC") amino acid sequence |
| Ab 77 | 153 | QVQLVQSGAEVKKPGASVKLSCKASGYTFTRFYIHNVRQAPGQGLEWMGIINPSG GGTSYAQNFQDRVTMTRDTSTSTVMELRSEDTAVYYCARNGYSTRSLQNNW FDPWGQGTLVTVSS | ADI-14411 | Heavy chain variable region ("HC") amino acid sequence |
| Ab 77 | 154 | ETTLTQSPSSLSASVGDRVTITCRASQSIDNVLNWYQQKPGKAPKLLIYEASSLQSGV PSRFSGSGSGTDFTLTISSLQPEDFATYYCQQTYSSLPYTFGQGTKVEIK | ADI-14411 | Light chain variable region ("LC") amino acid sequence |
| Ab 78 | 155 | QVQLVQSGAEVKKPGASVKVSCKASGYTFTDTYNIATMELRLRSDDTAVYYCARDMWITVGGIIA PDYWGQGTLVTVSS | ADI-14412 | Heavy chain variable region ("HC") amino acid sequence |
| Ab 78 | 156 | ETTLIQSPGILSLSPGERATLSCRASQSVSSDYLAMFQQKPGQAPRLLIYGASSRAT DIPDRFSGSGSGTDFTLTISRLESEDFAVYYCLHYAGARTFGQGTKVEIK | ADI-14412 | Light chain variable region ("LC") amino acid sequence |
| Ab 79 | 157 | EVQLVESGGVVVQPGGSLRLSCAASGFNFDDYSMHWVRQAPGKGLEWVSISW DGGITYYADSVKGRFTMSRDNGKKSLYLQMNSLRTEDTAVYYCGKDGDIYSSSSAG IDYWGQGTLVTVSS | ADI-14413 | Heavy chain variable region ("HC") amino acid sequence |
| Ab 79 | 158 | SYVLTQPPSASGTPGQRVIISCSGSSNIGSHTVKYYQQLPGTAPKLLIDRNNQRPS GVPDRFSGSGPKSGTSASLAISGLQSEDEADYCASWDDSLNGPVFGGGTQLTVL | ADI-14413 | Light chain variable region ("LC") amino acid sequence |
| Ab 80 | 159 | QVQLVQSGAEVKKPGSSMKVSCKASGGSFSSYGISWLRQAPGQAPEWMGGIIPIF GTINYAQKFQGRITISSADESTSTVMELSSLRIEDTAVYYCARDGRTSPRYYGWDVW GQGTTVTVSS | ADI-14414 | Heavy chain variable region ("HC") amino acid sequence |
| Ab 80 | 160 | DIRLTQSPATLSLSPGDRATLSCRASQSLYTYLSWYQQKPGQAPRLLIYDASNRATGI PARFSGSGSGTDFTLTISSLEPEDFAVYYCHYRSNMPPCTFGGGTKVDIK | ADI-14414 | Light chain variable region ("LC") amino acid sequence |
| Ab 81 | 161 | EVQLVESGPGLVKPSETLSLTCTVSGGSISNYYWTWIRQPPGEGLEWIGYIYYTGST NYNPSLKNRVTISVDTPKNQFSLKLNSVTAADTAVYYCARGWGYSYGYESYNGLD VWGQGTTVTVSS | ADI-14415 | Heavy chain variable region ("HC") amino acid sequence |
| Ab 81 | 162 | DIQLTQSPSFLSASVGDRVTITCRASQGISSYLAWYQLKPGKAPKLLIYAAATLETGVP SRFSGSGSGTEFTLTIISGLQPEDFATYYCQQLNSFPFTFGPGTKVEIK | ADI-14415 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 82 | 163 | QVQLVQSGAEVKKPGESLKISCKGSGDTFSRNWIGWVRQMPGKGLEWMGIIWP GDSDTRYRQFPQGQQGQVIISVDKSISTAYLQWSSLKASDTATYYCATSPYGLGSYY EHWGQGTLVTVSS | ADI-14416 | Heavy chain variable region ("HC") amino acid sequence |
| Ab 82 | 164 | NFMLTQPHSLSDSPGKTVVISCTRSSGSIASNYVQNYQQRPGSAPTTVIYEDNQRP SGVPDRFSGSIDSSSNSASLTISGLKTEDEADYYCQSYDSSNPYVFGTGTKVTVL | ADI-14416 | Light chain variable region ("LC") amino acid sequence |
| Ab 83 | 165 | EVQLVESGGGLVKPGGSLRLSCAASGFSFSSYSMHWVRQAPGKGLEWVSSISGSST YIYHADSVKGRFTISRDNAERSLHLQMNSLRAEDTAVYYCARDPYSSGWLDSWGQ GTLVTVSS | ADI-14417 | Heavy chain variable region ("HC") amino acid sequence |
| Ab 83 | 166 | ETTLTQSPATLSVSPGERATLSCRASQSVSGNLAWYQQKPGQAPRLLIYGTSTRAIG IPARFSGSGSGTEFTLSISSLQSEDFAVYYCQQYNKWPRYTFGQGTKLEIK | ADI-14417 | Light chain variable region ("LC") amino acid sequence |
| Ab 84 | 167 | QVQLVQSGAEVKKPGSSVKVSCKASGGTFTNYNIINWVRQAPGQGLQWMGRISP TFAIANYAQKFQGRVTITADKSTSTAYMELSSLRSEDTAVYYCARAPHSGYDLALDY WGQGTLVTVSS | ADI-14418 | Heavy chain variable region ("HC") amino acid sequence |
| Ab 84 | 168 | DIQMTQSPSTLSASVGDRVTITCRASQSISSWLAWYQQKPGKAPKLLIYEASSLQSG VPSRFSGSGSGTEFTLTITSLQPDDFATYYCQQYNVYPWTFGQGTKVDIK | ADI-14418 | Light chain variable region ("LC") amino acid sequence |
| Ab 85 | 169 | EVQLVESGGGVVQPGGSLRLSCAASGFSFSDYGMHWVRQAPGKGLEWVSFIRYD ASYKFYADSVKGRFTISRDNAKNTLYLQINSLRAEDTAVYYCAKEIYGSGSYYYYYAI DVWGQGTTVTVSS | ADI-14419 | Heavy chain variable region ("HC") amino acid sequence |
| Ab 85 | 170 | EIVLTQSPGTLSLSPGERATLSCRASQSVSSSHLAWYQQKPGQAPRLLIYGASSRATG IPDRFSGSGSGTDFTLTISRLEPEDFAVYYCQQYFRSAWAPGQGTKVDIK | ADI-14419 | Light chain variable region ("LC") amino acid sequence |
| Ab 86 | 171 | EVQLVESGGGVVVQPGGSLRLSCAASGFNFDDYAMHWVRQAPGKGLEWVSLISW DGGNTYYSDSVKGRFTISRDNGKNSLYLQMNSLRAEDTALYYCAKDIDRYSGYDYV FHYWGQGTLVTVSS | ADI-14420 | Heavy chain variable region ("HC") amino acid sequence |
| Ab 86 | 172 | DIRLTQSPSTLSAYVGDRVTITCRASQSISWLAWYQQKPGKAPKLLIYKASSLESGV PSRFTGSGSGTEFTLTISLQPDDFATYYCQQYNSYTFGGGTKVDIK | ADI-14420 | Light chain variable region ("LC") amino acid sequence |
| Ab 87 | 173 | QVQLVQSGAEVKKPGESLKISCKGSGYSINWIGYWIGWVRQMPGKGLEWMGI INPGDSDTRYSPSFQQVTISVDKSISTAYLQWGSLKASDTAMYYCARRAYRSGWH FDLWGRGTLVTVSS | ADI-14421 | Heavy chain variable region ("HC") amino acid sequence |
| Ab 87 | 174 | EIVMTQSPATLSVSPGERATLTCRASQSVSSNLAWYQQKPGQAPRLLIYGASTRAT GIPARFSGSGSGTQFTLTISSLQSEDFAVYYCQHYNNWPPYTFGQGTKVEIK | ADI-14421 | Light chain variable region ("LC") amino acid sequence |
| Ab 88 | 175 | QVQLVQSGAEVKKPGSSVKVSCKASGGTFSSYTINWVRQAPGQGLEWMGRIIPIL GIANYAQKFQGRVTITADKSTSTAYMELSSLRSEDTAVYYCARRHQDTYGMDVWG QGTTVTVSS | ADI-14422 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 88 | 176 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGSVFGGGTKVTVL | ADI-14422 | Light chain variable region ("LC") amino acid sequence |
| Ab 89 | 177 | EVQLVESGGVVIQPGGSLRLSCAASGFNFDDYSMHWVRQAPGKGLEWVSLISWD GGITYYADSVKGRFTISRDNGKKSLYLQMNSLRTEDTALYYCAKDIDIYSDYAGYPDY WGQGTLVTVSS | ADI-14423 | Heavy chain variable region ("HC") amino acid sequence |
| Ab 89 | 178 | DIRMTQSPSSLSASVGDRVTITCRASQGIRNDLGWYQQKPGKAPKRLIYAASSLQSG VPSRFSGSGSGTEFFLTISSLQPEDFATYYCLQHNSYPFTFGQGTRLEIK | ADI-14423 | Light chain variable region ("LC") amino acid sequence |
| Ab 90 | 179 | QVQLVQSGAEVKKPGESLKISCKGPDSSFSVYWIAWVRQMPGKGLEWMGVIYVG DSDTRYSPSFRGQVTISADKSMNTAYLQWSSLKASDTAMYFCARHIPPGPFDLWG QGTMVTVSS | ADI-14424 | Heavy chain variable region ("HC") amino acid sequence |
| Ab 90 | 180 | NFMLTQPHSVSASPGKTITISCTRSSGSIASNSVQWYQQRPGSAPTNVIYEDDQRPL GVPNRFSGSIDSSSNSASLTISGLKTEDEADYYCHSYHNSDQVFGGGTKLTVL | ADI-14424 | Light chain variable region ("LC") amino acid sequence |
| Ab 91 | 181 | QVQLQESGPGLVKPSETLSLTCTVSGGSVRSGSYYMSWIRQPPGKALEWIGYIYYSG STNYNPALESRVTISVDTSKNQFSLMLSSVTAADTAVYYCARSAEGLARLYYFDHWG QGTLVTVSS | ADI-14425 | Heavy chain variable region ("HC") amino acid sequence |
| Ab 91 | 182 | QSVLIQPASVSGSPGQSITISCTGTSSDVGGYNYVSWYQQHPGKAPKLMIHDVSNR PSGVSNRFSGSKSGNTASLTISGLQAEDEADYYCSTYRSSNTLVVFGGGTKLTVL | ADI-14425 | Light chain variable region ("LC") amino acid sequence |
| Ab 92 | 183 | EVQLVESGGGVVQPGRSLRLSCAASGFTISRDNSKNTLYLQINSLRAEDTAVYYCAREVVIAAHFDYWG QGTLVTVSS | ADI-14426 | Heavy chain variable region ("HC") amino acid sequence |
| Ab 92 | 184 | SSELTQEPAVSVALGQTVRITCQGDSLRSFYANWYQQKPGQAPILVIYGKNDRPSGI PDRFSGSNSGNTASLTITGAQAEDEADYYCNSRDSSGNHRVFGGGTKVTVL | ADI-14426 | Light chain variable region ("LC") amino acid sequence |
| Ab 93 | 185 | QVQLVQSGAEVKKPGSSVKVSCKASGGTFNSYTINWVRQAPGQGLEWMGRIITIP GATNYAQKFQGRVTFTADKSTSTAYMELSRSEDTAVYFCAKRGTGYYGMDVW GQGTTVTVSS | ADI-14427 | Heavy chain variable region ("HC") amino acid sequence |
| Ab 93 | 186 | QSVLIQPRSVSGSPGQSVTISCTGTSSDVGGYNYVSWYQQHPGKAPKLMIYDVSER PSGVPDRFSGSKSGNTASLTISGLQAEDEADYYCCSFVGIYILVFGGGTKLTVL | ADI-14427 | Light chain variable region ("LC") amino acid sequence |
| Ab 94 | 187 | EVQLLESGGGLVKPGGSLRLSCAASGFTFSDHYMSWIRQAPGKGLEWVSYISSTSSF TNYADSLKGRFTISRDNAKNSLYLQMNSLRAEDTAVYYCARPYIVALGTRAPFDIWG QGTTVTVSS | ADI-14428 | Heavy chain variable region ("HC") amino acid sequence |
| Ab 94 | 188 | SYVLIQPPSVSVAPGKTARITCGGNNIGSKTVHWYQQKPGQAPVLVSYYDSDRPSG IPERFSGSNSGNTATLTISRVEAGDEADYYCQVWDGSSEHVFGTGTKVTVL | ADI-14428 | Light chain variable region ("LC") amino acid sequence |
| Ab 95 | 189 | QVQLVQSGTEVKKPGSSVKVSCKASGGTFSSYTISWVRQAPGQGLEMMGITPM VGTPNYAQKFQGRVAITADKSTNTAYMELTSLISGDTAVYYCARLVYGSGSHFDYW GQGTLVTVSS | ADI-14564 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 95 | 190 | SSELSQDPAVSVALGQTVRITCQGDSLRSFYASWYQQQPGQAPVLVLYGQDNRPS GIPDRFSGSSSGNTASLTITGAQAEDEADYYCNSRNSSGHHWVFGGGTKVTVL | ADI-14564 | Light chain variable region ("LC") amino acid sequence |
| Ab 96 | 191 | EVQLLESGGGLVKPGGSLRLSCAASGFTFSNAWMSWVRQAPGKGLEWVGRIKSKT DGGTTDYAAPVKGRFTISRDSKNTLYLQMNSLKTEDTAVYYCTTDRFCSSTSCEYY YYYGMDVWGQGTTVTVSS | ADI-14565 | Heavy chain variable region ("HC") amino acid sequence |
| Ab 96 | 192 | ETTLIQSPSSLSASVGDRVTITCRASQSISSYLNWYQQKPGKAPKLLIYAASSLQSGV PSRFSGSGSGTDFTLTISSLQPEDFATYYCQQSYSTPYTFGQGTKVEIK | ADI-14565 | Light chain variable region ("LC") amino acid sequence |
| Ab 97 | 193 | QVQLLESGGGVVQPGRSLRLSCAASGFTFSSFPMHWVRQAPGKGLEWVAYASYD GRNNYYAGSVKGRFTISRDNSKNTLYLQINSLRAEDTAVYYCAREVVIAAHFDYWG QGTLVTVSS | ADI-14566 | Heavy chain variable region ("HC") amino acid sequence |
| Ab 97 | 194 | SSELTQEPAVSVALGQTVRITCQGDSLRSFYANWYQQKPGQAPILVLYGKNDRPSGI PDRFSGSNSGNTASLTITGAQAEDEADYYCNSRDSSGNHRVFGGGTKVTVL | ADI-14566 | Light chain variable region ("LC") amino acid sequence |
| Ab 98 | 195 | QVQLVQSGAEVKKPGASVKVSCKASGYTFNSYSISWVRQAPGQGLEWMGWISVH NGNTNYTQKFQGRVTMTTDTSTSTYMELRSLRSDDTAVYYCIFGELLYDVWGQG TTVTVSS | ADI-14567 | Heavy chain variable region ("HC") amino acid sequence |
| Ab 98 | 196 | DIQLTQSPSSLSASVGDRVTITCRASQGISNVLAWYQQKPGKVPNLLIYAASTLQSG VPSRFSGSGSGTDFTLTISSLQPEDVATYYCQKYNSAPLTFGPGTKVEIK | ADI-14567 | Light chain variable region ("LC") amino acid sequence |
| Ab 99 | 197 | EVQLVESGGGVVQPGRSLRLSCAASGFTFSSYGMHWVRQAPGKGLEWVAVIWYD GSNKYYADSVKGRFTISRDNSKNTLYLQMNSLRAEDTAVYYCARDIAAAGTMRAFD IWGQGTTVTVSS | ADI-14568 | Heavy chain variable region ("HC") amino acid sequence |
| Ab 99 | 198 | QSVLIQPASVSGSPGQSITISCTGTSSDVGGYNYVSWYQQHPGKAPKLMIYDVSNR PSGVSNRFSGSKSGNTASLTISGLQAEDEADYYCSSYTSSSTLVVFGGGTKLTVL | ADI-14568 | Light chain variable region ("LC") amino acid sequence |
| Ab 100 | 199 | QVQLVESGGGFVKPGGSLRLSCAASGFTFSDYYMSWIRQAPGKGLEWLSYISSTSLF TYYADSVKGRFTISRDNAKNSLYLQMNSLRADDTAVYYCARAYGKGTMVGYWGQ GTMVTVSS | ADI-14569 | Heavy chain variable region ("HC") amino acid sequence |
| Ab 100 | 200 | EIVMTQSPGTLSLAPGERATLSCRASQSVSIDYLAWYQHKPGQAPRLLIYTASNRAT GIPDRFSGSGSGTDFTLTISRLEPEDVAMYCQQYGNSPYTFGQGTKVEIK | ADI-14569 | Light chain variable region ("LC") amino acid sequence |
| Ab 101 | 201 | QVQLVQSGAEVKKPGSSVKVSCKASGFTFSTYTITWVRQAPGQGLEWMGRIVPIF GVVNNAQKFLGRLTITADKSTSTAYMELSSLRSEDTAVYYCARIPCSGNCQDYYYG MDVWGQGTTVTVSS | ADI-14571 | Heavy chain variable region ("HC") amino acid sequence |
| Ab 101 | 202 | DIQLTQSPSFLSASVGDRVTITCRASQGISSYLVWYQQKPGKAPKLLIYAASTLQSGV PSRFSGSGSGTEFTLTISSLQPEDFATYYCQQLNNYPPTFGPGTKVDIK | ADI-14571 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 102 | 203 | QVQLVQSGGGLVKPGGSLRLSCAASGFTFSNAWISWVRQAPGKGLEWVGRIKSAT DGGTTDYAAPVKGRFTISRDDSKNTLYLQMDSLKTEDTAVYYCTTSYPYFDWLPFSV DYWGQGTLVTVSS | ADI-14572 | Heavy chain variable region ("HC") amino acid sequence |
| Ab 102 | 204 | SYELMQPPSASGTPGQRVTISCSGSNSNIGSNTVSWYQQLPGTAPKLLIYNNNQRP SGVPDRFSGSKSGTSASLAISGLQSEDEADYYCATWDDSLNGWVFGGGTKLTVL | ADI-14572 | Light chain variable region ("LC") amino acid sequence |
| Ab 103 | 205 | QVQLVQSGAEVKKPGASVKVSCKASGYTFTTYGISWVRQAPGQGLEWMGWISTY KTYTNYAQKFQGRVTMTTDTSTSTAYMELRSLRSDDTAVYYCAKVAGGSGSYGDY WGQGTLVTVSS | ADI-14573 | Heavy chain variable region ("HC") amino acid sequence |
| Ab 103 | 206 | QPVLTQPPSVSVAPGKTARITCGGNNIGSKSVHWYLQKPGQAPVLVIYYDSDRPSGI PERFSGSNSGNTATLTISRVEAGDEADFFCQVWDSSSDHWVFGGGTKVTVL | ADI-14573 | Light chain variable region ("LC") amino acid sequence |
| Ab 104 | 207 | QVQLVQSGAEVKKPGSSVKVSCKASGGTFSSYTISWRQAPGQGLEWMGRIIPILG IANYAQKFQGRVTIITADKSTSTAYMELSSLRSEDTAVYYCARPSSSSFAPDYWGQGT LVTVSS | ADI-14575 | Heavy chain variable region ("HC") amino acid sequence |
| Ab 104 | 208 | QSVLTQPASVSGSPGQSITISCTGTSSDVGGYNYVSWYQQHPGKAPKLMIYDVSNR PSGVSNRFSGSKSGNTASLTIISGLQAEDEADYYCSSYTSSSTPVVFGGGTKVTVL | ADI-14575 | Light chain variable region ("LC") amino acid sequence |
| Ab 105 | 209 | QVQLVQSGAEVKKPGASVKVSCKASGYTFTSYGISWVRQAPGQGLEWMGWISAY NGNTNYAQKLQGRVTMTTDTSTSTAYMELRSLRSDDTAVYYCARDPPVIAAGDFQ HWGQGTLVTVSS | ADI-14576 | Heavy chain variable region ("HC") amino acid sequence |
| Ab 105 | 210 | DIVLTQSPLSLPVTLGQPASISCRSSQSLVHSDGNTYLNWFQQRPGQSPRRLIYKVS NRDSGVPDRFSGSGSGTDFTLKISRVEAEDVGVYYCMQGTHWPDFGQGTRLEIK | ADI-14576 | Light chain variable region ("LC") amino acid sequence |
| Ab 106 | 211 | QVQLVQSGAEVKKPGASVKVSCKASGYTFTNYGITWVRQAPGQGLEWMGWISA YNGVRNYAQKLQGRVTMTIDTSRTTAYMELRKNLRSDDTAMYYCARGPPVIAADDF QHWGQGTMVIVSS | ADI-14577 | Heavy chain variable region ("HC") amino acid sequence |
| Ab 106 | 212 | DIQMTQSPLSLPVTLGQPASISCRSSQSLVHSNGDTYLNWFQQRPGRSPRRLIYKVS NRDSGVPDRFSGSGSGTDFTLKISRVEAEDVGVYYCMQGTHWPPDFGQGTRLEIK | ADI-14577 | Light chain variable region ("LC") amino acid sequence |
| Ab 107 | 213 | QVQLVQSGAEVKKPGASVKVSCKASGGTFNNYAINWVRQAPGQGLEWMGIIP MFGTANYAQKFQGRVTMTADESTSTAYMELSSLRSEDTAVYYCASSQIFVGGNYY KLEFDNWGQGTLVTVSS | ADI-14578 | Heavy chain variable region ("HC") amino acid sequence |
| Ab 107 | 214 | QSVLTQPPSVSAAPGQKVTISCSGSNSNIGYNDVSWYQQLPGTAPQLLIYDNNKRT SGIPDRFSGSKFGTSATLGITGLQTGDEADYYCGTWDSSLSTVIFGGGTKLTVL | ADI-14578 | Light chain variable region ("LC") amino acid sequence |
| Ab 108 | 215 | QVQLVQSGAEVKKPGESLKISCKVSGYSFTSYWIGWVRQMPGKGLEWMGIIYPGD SDTRYSPSFQQGVTISADKSITTAYLQWSSLKASDTAMYYCARPAHSSSWYGAFDL WGQGTTVTVSS | ADI-14579 | Heavy chain variable region ("HC") amino acid sequence |
| Ab 108 | 216 | DIQMTQSPSSLSASVGDRVTITCRASQGISNYLAWYQQKPGKVPKLLIYAASTLQSG VPSRFSGSGSGTDFTLTISSLQPEDVATYYCQKYNSAPLTFGGGTKVEIK | ADI-14579 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 109 | 217 | QVQLVQSGAEVKKPGSSVKVSCKASGTFSSYTINWVRQAPGQGLEWMGRIIPVLGMASYVQNFQGRVSITADESTSTAYMELSSLTSEDTALYYCAKGAVAAANDVFDVWGQGTTVTVSS | ADI-14580 | Heavy chain variable region ("HC") amino acid sequence |
| Ab 109 | 218 | DIQMTQSPDSLAVSLGERATLNCKSSQSVFYSSNNKHYLAWYQQKPGQPPKLLFYWASTRESGVPDRFSGSGSGTDFTLTISSLQAEDVAVYYCQQYYRIPYTFGQGTKVEIK | ADI-14580 | Light chain variable region ("LC") amino acid sequence |
| Ab 110 | 219 | QVQLVQSGAEVKKPGSSVKVSCKASGTFSSHAFSWVRQAPGQGLEWMGGIIPSLNTANYAQKFQGRVSITADESTGTAYMELSSLRSDDTAVYFCAREVFGYGYYFDYWGQGTLVTVSS | ADI-14581 | Heavy chain variable region ("HC") amino acid sequence |
| Ab 110 | 220 | ETTLTQSPATLSVSPGERATLSCRASQNVNSNLAWYQQKPGQAPRLLIYGASTRATGIPARFSGSGSGTDFTLTISSLQSEDFAVYYCQQYNMWPPTFGQGTKLEIK | ADI-14581 | Light chain variable region ("LC") amino acid sequence |
| Ab 111 | 221 | QVQLVQSGAEVKKPGESLKISCKGPDSSFSVYWIAWVRQMPGKGLEWMGVIYVGDSDTRYSPSFRGQVTISADKSINTAYLQWSSLKASDTAMYFCARHIPGPFDLWGQGTTVTVSS | ADI-14582 | Heavy chain variable region ("HC") amino acid sequence |
| Ab 111 | 222 | NFMLTQPHSVSASPGKTITISCTRSSGSIASNSVQWVQQRPGSAPTNVIYEDNQRPLGVPNRFSGSIDSSSNSASLTISGLKTEDEADYYCQSYHSSDQVFGGGTKVTVL | ADI-14582 | Light chain variable region ("LC") amino acid sequence |
| Ab 112 | 223 | QVQLVQSGAEVKEPGASVKVSCKASGTFTNYGISWVRQAPGQGLEWLGWISAYNGNIHYAQKVQGRVTMTDTSTGMELRSLRSDDTAVYYCAREPPVIAAGDFQHWGQGTLVTVSS | ADI-14583 | Heavy chain variable region ("HC") amino acid sequence |
| Ab 112 | 224 | ETTLTQSPLSLPVTLGQPASISCRSSQSLVHSNGNTYLSWFQQRPGQSPRRLIYRVSNRDSGVPDRFSGSGSGTDFTLKISRVEAEDVGLYYCMQGTHWPPDFGQGTRLEIK | ADI-14583 | Light chain variable region ("LC") amino acid sequence |
| Ab 113 | 225 | QVQLVQSGAEVKKPGASVKVSCKASGTFTNYGTSYGITWVRQAPGQGLEWMGWINTSNGNPNYAQKLQGRVTMTADTSTSTAYMELRSLISDDTAVYYCARGHRMVRGVVPTGYYGLDVWGQGTTVTVSS | ADI-14584 | Heavy chain variable region ("HC") amino acid sequence |
| Ab 113 | 226 | DIQLTQSPSSLSASVGDRVTITCRASQSISSYLNWYQQKPGKAPKLLIFAASNLQSGVPSRFSGSGSGTDFTLTISSLQPEDFATYYCQQSYITPWTFGQGTKVEIK | ADI-14584 | Light chain variable region ("LC") amino acid sequence |
| Ab 114 | 227 | QVQLVQSGAEVKKPGASVKVSCKASGYTFANYGIGWVRQAPGQGLEWMGWISAYNGKTNYAQKFQGRVTMTDTSTSTAYMELSLRSDDTAVYYCAREPPVIAAGDFPHWGQGTLVTVSS | ADI-14585 | Heavy chain variable region ("HC") amino acid sequence |
| Ab 114 | 228 | ETTLTQSPLSLPVTLGQPASISCRSSQSLEHSDLNTYLSWFQQRPGQSPRRLIYKVSNRDSGVPDRFSGSGSGTDFTLRISRVEAEDVGVYYCMQGTHWPPDFGQGTRLEIK | ADI-14585 | Light chain variable region ("LC") amino acid sequence |
| Ab 115 | 229 | QVQLVQSGGGLVKPGGSLRLSCAASGFTFSDYYMSWIRQAPGKGLEWVSISSSSSYTNYADSVKGRFTISRDNAKNSLYLQMNSLRAEDTAVYYCAKRTEYCSSTGCAYYFDYWGQGTLVTVSS | ADI-14586 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 115 | 230 | QSVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGSVFGGGTKVTVL | ADI-14586 | Light chain variable region ("LC") amino acid sequence |
| Ab 116 | 231 | EVQLLESGGGLVKPGGSLRLSCAASGFTLTSYSMNWVRQAPGKGLEWVSSISSSSS YIHYADSVKGRFTISRDNAKNSLYLQMNSLRAEDTAVYYCAGSSLYPPFFDYWGQG TLVTVSS | ADI-14587 | Heavy chain variable region ("HC") amino acid sequence |
| Ab 116 | 232 | QSVVTQPPSVSGAPGQRVTISCTGSSSNLGAGYDVHWYQQLPGTAPKLLIYGNNN RPSGVPDRFSGSKSGTSASLAITGLQAEDEADYYCQSYDSSLSSVVEGGGTKLTVL | ADI-14587 | Light chain variable region ("LC") amino acid sequence |
| Ab 117 | 233 | QVQLVQSGAEVKKPGASVKVSCKVSGDTLTELSIHWVRQAPGKGHEWMGYFDHE DGEIMYAQKFQGRVTMTGDTSTDTAYMELSSLRSEDTAVYYCATVAAAGQFDYW GQGTLVTVSS | ADI-14588 | Heavy chain variable region ("HC") amino acid sequence |
| Ab 117 | 234 | DIQLTQSPSSLSASVGDRVTITCRARQSISTYLNWYQQKPGKAPKLLIYAASSLQSGV PSRFSGSGSGTDFTLTISSLQPEDFATYYCQQSYSSPYTFGQGTKVDIK | ADI-14588 | Light chain variable region ("LC") amino acid sequence |
| Ab 118 | 235 | QITLKESGPVLVKPSETLLTCTVSGFSLSNAKMGVSWIRQPPGKALEWLAHIFSND EKSYNTSLKNRLTISKDTSKSQVVLTMTNMDTVDTATYYCARINYDSSGYYLANFD YWGQGTLVTVSS | ADI-14589 | Heavy chain variable region ("HC") amino acid sequence |
| Ab 118 | 236 | NIRLTQSPSSLSASVGDRVTITCRASQRIASYLNWYQQKPGHAPKLLIHAASSLQSGV PSRFSGSGSGTDFTLTINSLLPEDFATYYCQQSYSSPPHSSPPLTFGGGTKVEIK | ADI-14589 | Light chain variable region ("LC") amino acid sequence |
| Ab 119 | 237 | EVQLVQSGAEVKKPGESLKISCKGSGYSFATYWIGWVRQMPGKGLEWMGIIYPGD SDTRYSPSFQGQVTISADKSISTAYLQWSSLKASDTAIYYCARAKLPVAGLYYFDYWG QGTLVTVSS | ADI-14590 | Heavy chain variable region ("HC") amino acid sequence |
| Ab 119 | 238 | DIQLTQSPSSLSASVGDRVTITCRASQGISSTLAWYQQKPGKAPKLLIYDASSLESGV PSRFSGSGSGTDFTLTISSLHPEDFATYYCQQFNTYPTFGGGTKVEIK | ADI-14590 | Light chain variable region ("LC") amino acid sequence |
| Ab 120 | 239 | QVQLVQSGAEVKKPGESLRISCTGSGYTFTNYWISWVRQMPGKGLEWMGRIDPT DSYTNYSPSFQGHVTISADKSISTAYLQSSSLKASDTATYYCARHRRLVPAAMSRGYY GMDVWGQGTTVTVSS | ADI-14591 | Heavy chain variable region ("HC") amino acid sequence |
| Ab 120 | 240 | EIVMTQSPSSLSASVGDRATITCRASQSISSYLNWYQQKPGKAPKLLIYAASNLQSGA PSRFSGSGSGTDFTLTISSLQPEDFATYFCQQTYSTPYTFGQGTKVEIK | ADI-14591 | Light chain variable region ("LC") amino acid sequence |
| Ab 121 | 241 | QVQLVQSGAEVKKPGESLKISCKGSGYTFTNYWIGWVRQMPGKGLEWMGIIYPD SDTRYSPSFQGQVTISVDKSINTAYLQWSSLRASDTAIYYCACSNMPHYFDSWGQ GTLVTVSS | ADI-14592 | Heavy chain variable region ("HC") amino acid sequence |
| Ab 121 | 242 | NFMLTQPHSVSESPGKTVTISCTRSSGNIAGNYVQWYQQRPGSAPTTVIYEDNQRP SGVPDRFSGSIDSSSNSASLTISGLKTEDEAVYYCQSYHPGNWVFGGGTKLTVL | ADI-14592 | Light chain variable region ("LC") amino acid sequence |
| Ab 122 | 243 | QVQLVQSGAEVKKPGESLKISCKGSYSFSSYWAWVRQMPGKGLEWMGIIYPA DSDTRYSPSFQGQVTISADKSDTAYLQWGSLKASDTAMYCARSLYGSGDYFDY WGQGTLVTVSS | ADI-14593 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 122 | 244 | NFMLTQPHSVSESPGRTVTIISCTRSSGSIATNYVQWYQQRPGSAPTTVIYEDNQRPS GVPDRFSGSIDSSSNSASLTISGLKTEDEADYYCQSYGSGDVFGGGTKVTVL | ADI-14593 | Light chain variable region ("LC") amino acid sequence |
| Ab 123 | 245 | QVQLVQSGAEVKKPGASVKLSCKASGYTFTTYTINWVRQAPGQGLEWMGWISGY NGNTDYAQKLQGRFTMTIDTSTNTAYMELRSLTSDDTAVYYCAKGGGGSEYFDY WGQGTLVTVSS | ADI-14594 | Heavy chain variable region ("HC") amino acid sequence |
| Ab 123 | 246 | SYELTQPPSVSVAPGKTARISCGGNNIGSKSVHWYQQKPGQAPVLVIYDDRPSGI PERFSGSNSGNTATLTISRVEAGDEADYYCQLWDRSSDHPYVFGTGTKVTVL | ADI-14594 | Light chain variable region ("LC") amino acid sequence |
| Ab 124 | 247 | EVQLLESGGGLVQPGGSLRLSCAASGFTFSIYSMNWVRQAPGKGLEWISIYSRSGST IFYADSVKGRFTISRDDAKNSLFLQMTSLRDADTAVYYCARVDCSNNKCYDYWGQ GTLVTVSS | ADI-14595 | Heavy chain variable region ("HC") amino acid sequence |
| Ab 124 | 248 | DIQLTQSPATLSLSPGERATLSCRASQSISSFLAWYQQKPGQAPRLLIYDASKRATGT PARFSGGGSGRDFTLTISSLEPEDFAVYYCQQRSSWPLYTFGQGTKVEIK | ADI-14595 | Light chain variable region ("LC") amino acid sequence |
| Ab 125 | 249 | EVQLVESGGVVVQPGGSLRLSCAVSGFNFDDYSMHWVRQLPGKGLEWVSLLISWD GGITYYADSVKGRFTISRDNSKNSLYLQMNSLRTEDTALYYCAKDGNRYSDNDYYFD YWGQGTLVTVSS | ADI-14597 | Heavy chain variable region ("HC") amino acid sequence |
| Ab 125 | 250 | DIRLTQSPGILSLSPGERATLSCRASQGVSSSYLAWYQQKPGQAPRLLIYGASSRAT GIPDRFSGSGSGTDFTLTISRLEPEDFAVYYCQQYGSSPLFGPGTKVEIK | ADI-14597 | Light chain variable region ("LC") amino acid sequence |
| Ab 126 | 251 | QVQLVESGAEVKKPGSSVKVSCKASGGTFSSYAIYWVRQAPGQGLECMGGIIPIFG SANYAQKFQGRVTITADESTSTAYMELSSLRSEDTAVYYCATDSLKTTYYGSSGYFR DHVWGQGTTVTVSS | ADI-14598 | Heavy chain variable region ("HC") amino acid sequence |
| Ab 126 | 252 | ETTLTQSPSSLSASVGDRVTITCRASQGISNYLAWYQQKPGKVPKLLIFAASTLQSGV PSRFSGSGSGTDFTLTISSLQPEDVATYYCQNFNSVLSFTFGPGTKVDIK | ADI-14598 | Light chain variable region ("LC") amino acid sequence |
| Ab 127 | 253 | EVQLVESGGGLVQPGRSLRLSCKTSGFTFGDYAMSWVRQAPGQGLDMVGFIRTK AYGGTTEYAASVKGRFTLSRDDSKSIAYLQMNSLKTEDTAVYYCKSGGGFDYWGR GTLVTVSS | ADI-14599 | Heavy chain variable region ("HC") amino acid sequence |
| Ab 127 | 254 | NFMLTQPHSVSGSPGKTVTISCTGSSGSIASNYVQWYQQRPGSAPTTVICEDNQRP SGVPDRFSGSGIDSSSNSASLIISGLKTEDEADYYCQSYDRSNQEVFGGGTKLTVL | ADI-14599 | Light chain variable region ("LC") amino acid sequence |
| Ab 128 | 255 | QVQLVQSGGGLVKPGGSLRLSCAASGFSFDYYMNWIRQAPGKGLEWVSYISSSSS YTNYADSVKGRFTISRDNAKKSLYLQMNSLRAEDTAVYYCASQTYSDYARGGAFDI WGQGTTVTVSS | ADI-14600 | Heavy chain variable region ("HC") amino acid sequence |
| Ab 128 | 256 | QSVLTQPPSVSGAPGQRVTISCTGSSSNIGAGYDVHWYQQLPGTAPKLLIYGNNNR PSGVPDRFSGSKSGTSASLAITGLQAEDEADYYCQSYDSSLSGSVFGIGTKVTVL | ADI-14600 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 129 | 257 | EVQLLESGGGLVQPGGSLRLSCAASGFTFSSYAMHWVRQAPGKGLEWVSTISGSSG SSTYYADSVEGRFTISRDNSKNTLYLQMNSLRAEDTAIYYCAKEPRDMYIQQWLDS WGQGTLVTVSS | ADI-14601 | Heavy chain variable region ("HC") amino acid sequence |
| Ab 129 | 258 | GIRLTQSPSSVSASVGDRVIITCRASQGIRSWLAWYQQKPGKAPKLLIYAASRLQSG VPSRFSGSGSETDFTLTISSLQPEDFASYYCQQANSFPLTFGGGTKVEIK | ADI-14601 | Light chain variable region ("LC") amino acid sequence |
| Ab 130 | 259 | EVQLVESGGGVVQPGGSLRLSCAASGFSFSSCGMHWRQVSGKGLEWVAFIRYD GSNKFYADSVKGRFTIISRDNSKNTLYILQMNSLRVEDTAVYYCAKGGLEDVSTGYSP HYYYGMDVWGQGTTVTVSS | ADI-14602 | Heavy chain variable region ("HC") amino acid sequence |
| Ab 130 | 260 | QPVLTQPPSVSVSPGQTASITCSGDKLAYKTCWYQQKPGQSPVLVIFQDSKRPSGI PERFSGSNSGNTATLTISGTQALDEADYYCQAWDSSTVVFGGGTKLTVL | ADI-14602 | Light chain variable region ("LC") amino acid sequence |
| Ab 131 | 261 | QVQLVQSGAEVKKPGESLKISCKGSGYTFTNYWIGWVRQMPGKGLEWMGIIYPG DSDTRYSPSFQGQVTISADKSITTAYLQWRVLKASDTAMYYCATMRGSSSHPHHW GQGTLVTVSS | ADI-14603 | Heavy chain variable region ("HC") amino acid sequence |
| Ab 131 | 262 | DIQVTQSPSSLSASVGDRVTITCRAGQGIGNYLAWYQQKPGKVPKVLIYAASTLQSG VPSRFSGSGSGTEFTLTISSLQPEDVATYYCQKYNNAPYAPGQGTRLEIK | ADI-14603 | Light chain variable region ("LC") amino acid sequence |
| Ab 132 | 263 | EVQLLESGGGLVQPGGSLRLSCAASGFTFNNYVMHWVRQAPGKGLEWVSSINGY VSTNYADSVKGRFTISRDNSKNTLYLQMRSLRAEDTALYYCVRDLIPHDSAYYGYH GMDVWGQGTTVTVSS | ADI-14604 | Heavy chain variable region ("HC") amino acid sequence |
| Ab 132 | 264 | QPVLTQPPSASGTPGQSVTISCSGSSSNIGTNVNWYQQLPGTAPKLLIYSNDLRPS GVPDRFSGSKSGTSASLAISGLQSEDEANYYCAAWDDSLNGVLFGGGTKLTVL | ADI-14604 | Light chain variable region ("LC") amino acid sequence |
| Ab 133 | 265 | EVQLLESGPALVKPTQTLTLTCTFSGRSLITSGMCVSWIRQPPGKALEWLARIDWD DDQYFSTSLRLRLSISKDTSKNQVVLTMTNMDPVDTATYYCARSALNIAARGFDIW GQGTTVTVSS | ADI-14605 | Heavy chain variable region ("HC") amino acid sequence ("HC") amino acid sequence |
| Ab 133 | 266 | QPGLTQPPSVSVSPGQTARITCSGDVLPKHFSYWYQQKPGQAPVLVIHRDSERPSG IPERFSGSSGTTVTLTISGVQAEDEADYYCQFSDIINTVFGGGTKLTVL | ADI-14605 | Light chain variable region ("LC") amino acid sequence |
| Ab 134 | 267 | QVQLVQSGGGLVQPGGSLRLSCAASGFTVSSNYMGWVRQAPGKGLEWVSVIYTG GSTYYADSVKGRFTISRDNFKNTLYLQMNSLRAEDTALYYCARDLYSSGWPGYWG QGTLVTVSS | ADI-14606 | Heavy chain variable region ("HC") amino acid sequence |
| Ab 134 | 268 | DIRLTQSPATLSVSPGERATLSCRASQSVSINLGWFQQKPGQSPRLLIYGTSTRATGI PARFSGSGSGTEFTLTISSLQSEDFAVYYCHQYNMMPYTFGQGTKVEIK | ADI-14606 | Light chain variable region ("LC") amino acid sequence |
| Ab 135 | 269 | EVQLLESGGGVVQSGRSLRLSCAASGFTFNNYAMHWRQAPGKGLEWVAVISFD GGNKFYGDSVQGRFTISRDNSKNTLYLQTNSLRPEDTAVYYCARDRWEIQIGLDIW GQGTTVTVSS | ADI-14607 | Heavy chain variable region ("HC") amino acid sequence |
| Ab 135 | 270 | SYVLTQPPSVSVSPGQTARITCSGDALARQNAYWYQQKPGQAPVLVMYRDTGRPS GIPERFSGSGSSGTTVTLTISEVQAEDEADYYCQSADSSGAYVFGTGTKVTVL | ADI-14607 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 136 | 271 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCARVGWGYSYGYWFDP WGQGTLVTVSS | ADI-19420 | Heavy chain variable region ("HC") amino acid sequence |
| Ab 136 | 272 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGVVFGGGTKLTVL | ADI-19420 | Light chain variable region ("LC") amino acid sequence |
| Ab 137 | 273 | EVQLLESGGGVVQPGRSLRLSCAASGFTFSSYGMHWVRQAPGKGLEWVAVISYD GSNKYYADSVKGRFTISRDNSKNTLYLQMNSLRAEDTAVYYCAKDIHHVLRFLDPDY WGQGTLVTVSS | ADI-19421 | Heavy chain variable region ("HC") amino acid sequence |
| Ab 137 | 274 | QSVLIQPASVSGFPGQSITISCTGTSSDVGGYNYVSWYQQHPGKAPKLMIYEVSNR PSGVSNRFSGSKSGNTASLTISGLQAEDEADYYCSSYTSSSTLVFGGGTKLTVL | ADI-19421 | Light chain variable region ("LC") amino acid sequence |
| Ab 138 | 275 | EVQLVESGGGVVQPGRSLRLSCAASGFTFSSYGMHWVRQAPGKGLEWVAVISYD GSNKYYADSVKGRFTISRDNSKNTLYLQMNSLRAEDTAVYYCAKEGYNWNDYYFD YWGQGTLVTVSS | ADI-19422 | Heavy chain variable region ("HC") amino acid sequence |
| Ab 138 | 276 | QPVLTQPPSVSVAPGKTARITCGGNNIGSKSVHWYQQKPGQAPVLVVYDDSDRPS GIPERFSGSNSGNTATLTISRVEAGDEADYYCQVWDSSSDHWVFGGGTKLTVL | ADI-19422 | Light chain variable region ("LC") amino acid sequence |
| Ab 139 | 277 | EVQLLESGGGLVQPGGSLRLSCAASGFTFSSYSNYMSWVRQAPGKGLEWVSDIYSGG RTDYADSVKGRFTISRDNSKNTLDLQMNSLRAEDTAVYYCARETLGMDHWYFDL WGRGTLVTVSS | ADI-19424 | Heavy chain variable region ("HC") amino acid sequence |
| Ab 139 | 278 | QPGLTQPPSVSVAPGKTARITCGGNNIGSKSVHWYQQKPGQAPVLVVYDDSDRPS GIPERFSGSNSGNTATLTISRVEAGDEADYYCQVWDSTSDHPVFGGGTKLTVL | ADI-19424 | Light chain variable region ("LC") amino acid sequence |
| Ab 140 | 279 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARLGYCSGGSCHFDYW GQGTLVTVSS | ADI-19425 | Heavy chain variable region ("HC") amino acid sequence |
| Ab 140 | 280 | QPVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGFYVFGIGTKLTVL | ADI-19425 | Light chain variable region ("LC") amino acid sequence |
| Ab 141 | 281 | QVQLQESGPGLVKPSETLSLTCTVSGGSISSYYWSWIRQPPGKGLEWIGYIYYSGST NYNPSLKSRVTISVDTSKNQFSLKLSSVTAADTAVYYCARGNEELGTGSNWFDPWG QGTLVTVSS | ADI-19426 | Heavy chain variable region ("HC") amino acid sequence |
| Ab 141 | 282 | SYVLTQPPSVSVSPGQTASITCSGDKLGDKYACWYQQKPGQSPVLVIYQDSKRPSGI PERFSGSNSGNTATLTISGTQAMDEADYYCQAWDSSTVFGGGTKLTVL | ADI-19426 | Light chain variable region ("LC") amino acid sequence |
| Ab 142 | 283 | EVQLVESGGGLVKPGGSLRLSCAASGFTFSSYSMNWVRQAPGKGLEWVSSISSSSS FISYADSVKGRFTISRDSAKNSLYLQMNSLRAEDTAVYYCARDHPNMNGLAYFDY WGQGTLVTVSS | ADI-19427 | Heavy chain variable region ("HC") amino acid sequence |
| Ab 142 | 284 | QSVLTQPPSISGAPGQRVTISCTGSSSNIGAGYDVQWHQQLPGTAPKLLIYGNSNR PSGVPDRFSGSKSGTSASLAITGLQAEDEADYYCQSYDSSLSGWVFGGGTKLTVL | ADI-19427 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 143 | 285 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCARDSCSGGSCYSPRFDP WGQGTLVTVSS | ADI-19428 | Heavy chain variable region ("HC") amino acid sequence |
| Ab 143 | 286 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSTVVFGGGTKLTVL | ADI-19428 | Light chain variable region ("LC") amino acid sequence |
| Ab 144 | 287 | EVQLQESGPGLVKPSETLSLTCTVSGGSISSSSYYWGWIRQPPGKGLEWIGSIYYSGS TYYNPSLKSRVTISVDTSKNQPSLKLSSVTAADTAVYYCARTPLYSYGRVVGFYYYGM DVWGQGTTVTVSS | ADI-19429 | Heavy chain variable region ("HC") amino acid sequence |
| Ab 144 | 288 | QSVLTQPPSVSGAPGQRVTISCTGSSSNIGAYDVHWYQQLPGTAPKLLIYGNSNR PSGVPDRFSGSKSGTSASLAITGLQAEDEADYYCQSYDSSLSGWVFGGGTKLTVL | ADI-19429 | Light chain variable region ("LC") amino acid sequence |
| Ab 145 | 289 | QVQLVQSGAEVKKPGSSVKVSCKAASGFTFSSYTISWVRQAPGQGLEWMGRIIPILG IANYAQKFQGRVTITADKSTSTAYMELSSLRSEDTAVYYCARDGPYYDSSGYYRL DYWGQGTLVTVSS | ADI-19430 | Heavy chain variable region ("HC") amino acid sequence |
| Ab 145 | 290 | DIRMTQSPLSLPVTLGQPASISCRSSQSLVYSDGNTYLNWFQQRPGQSPRRLIYKVS NRDSGVPDRFSGSGSGTDFTLKISRVEAEDVGVYYCMQGTHWTYITPGQGTKLEIK | ADI-19430 | Light chain variable region ("LC") amino acid sequence |
| Ab 146 | 291 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCQSYDSSLSGSVFGGGTKVTVL GQGTLVTVSS | ADI-19431 | Heavy chain variable region ("HC") amino acid sequence |
| Ab 146 | 292 | QPGLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGSVFGGGTKVTVL | ADI-19431 | Light chain variable region ("LC") amino acid sequence |
| Ab 147 | 293 | QVQLVQSGAEVKKPGASVKVSCKVSGYTLTELSMHWVRQAPGKGLEWMGGFDP EDGETIYAQKFQGRVTMTEDTSTDTAYMELSSLRSEDTAVYYCATEREEGGYSGYD DAFDIWGQGTMVTVSS | ADI-19432 | Heavy chain variable region ("HC") amino acid sequence |
| Ab 147 | 294 | DIRMTQSPSTLSASVGDRVTITCRASQSISSWLAWYQQKPGKAPKLLIYKASSLESG VPSRFSGSGSGTEFTLTISSLQPDDFATYYCQQYNSYSYTPGQGTKLEIK | ADI-19432 | Light chain variable region ("LC") amino acid sequence |
| Ab 148 | 295 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARAPPSVGGWYFDLW GRGTLVTVSS | ADI-19433 | Heavy chain variable region ("HC") amino acid sequence |
| Ab 148 | 296 | QPVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLVFGGGTKLTVL | ADI-19433 | Light chain variable region ("LC") amino acid sequence |
| Ab 149 | 297 | QVQLQESGPGLVKPSQTLSLTCTVSGGSISSGSYYWSWIRQPAGKGLEWIGRIYTSG STNYNPSLKSRVTISVDTSKNQFSLKLSSVTAADTAVYYCAREGRGGAFDIWGQGTL VTVSS | ADI-19435 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 149 | 298 | SYELTQPPSVSVSPGQTARITCSADALPKQYAYWYQQKPGQAPVLVIYKDSERPSGI PERFSGSGSGTTVTLTISGVQAEDEADYYCQSADSSGTYVFGGGTQLTVL | ADI-19435 | Light chain variable region ("LC") amino acid sequence |
| Ab 150 | 299 | QVQLVQSGPGLVKPSETLSLTCTVSGGSISSSSYYWGWIRQPPGKGLEWIGSIYYSG STYYNPSLKSRVTISVDTSKNQFSLKLSSVTAADTAVYYCARSLMNYSNYVLGFDPW GQGTLVTVSS | ADI-19436 | Heavy chain variable region ("HC") amino acid sequence |
| Ab 150 | 300 | QPVLTQPPSVSVSPGQTASITCSGDKLGDKYACWYQQKPGQSPVLVIYQDSKRPSG IPERFSGSNSGNTATLTISGTQAMDEADYYCQAWDSSTVVFGGGTKLTVL | ADI-19436 | Light chain variable region ("LC") amino acid sequence |
| Ab 151 | 301 | EVQLVQSGAEVKKPGASVKVSCKASGYTFTSTAYMELSRLSRSDDTAVYYCARDGIAAAGTLFD YWGQGTLVTVSS | ADI-19437 | Heavy chain variable region ("HC") amino acid sequence |
| Ab 151 | 302 | DIQLTQSPSSVSASVGDRVTITCRASQGISSWLAWYQQKPGKAPKLLIYAASSLQSG VPSRFSGSGSGTDFTLTISSLQPEDFATYYCQQANSFPLTFGGGTKVEIK | ADI-19437 | Light chain variable region ("LC") amino acid sequence |
| Ab 152 | 303 | EVQLVESGGGLVQPGGSLRLSCAASGFTFSSYAMSWVRQAPGKGLEWVSAISGSG GSTYYADSVKGRFTISRDNSKNTLYLQMNSLRAEDTAVYYCAKYSNYGSFDYWGQ GTLVTVSS | ADI-19439 | Heavy chain variable region ("HC") amino acid sequence |
| Ab 152 | 304 | DIQMTQSPSTLSASVGDRVTITCRASQSISWLAWYQQKPGKAPKLLIYKASSLESG VPSRFSGSGSGTEFTLTISSLQPDDFATYYCQQYNSYSTFGQGTKVEIK | ADI-19439 | Light chain variable region ("LC") amino acid sequence |
| Ab 153 | 305 | EVQLVESGGGLVQPGGSLRLSCAASGFTFSSYSMNWVRQAPGKGLEMVSYISSSSS TIYYADSVKGRFTISRDNAKNSLYLQMNSLRAEDTAVYYCAREGYSGSYGYYFDYW GQGTLVTVSS | ADI-19440 | Heavy chain variable region ("HC") amino acid sequence |
| Ab 153 | 306 | QSVLTQPPSVSVGAPGQRVTISCTGSSNIGAGYDVHWYQQLPGTAPKLLIYGNSNR PSGVPDRFSGSKSGTSASLAITGLQAEDEADYYCQSYDSSLSGSVFGIGTKLTVL | ADI-19441 | Light chain variable region ("LC") amino acid sequence |
| Ab 154 | 307 | QVQLVQSGAEVKKPGSSVKVSCKASGYTFSSYAISWVRQAPGQGLEWMGRIIPILG IANYAQKFQGRVTITADKSTSTAYMELSSLRSEDTAVYYCARGPLTGYSSSWFDPW GQGTLVTVSS | ADI-19441 | Heavy chain variable region ("HC") amino acid sequence |
| Ab 154 | 308 | EIVMTQSPSSLSASVGDRVTITCRASQSISSYLNWYQQKPGKAPKLLIYAASSLQSGV PSRFSGSGSGTDFTLTISSLQPEDFATYYCQQSYSTLPYTFGQGTKVEIK | ADI-19444 | Light chain variable region ("LC") amino acid sequence |
| Ab 155 | 309 | QVQLVQSGAEVKKPGASVKVSCKASGYTFTSYGISWVRQAPGQGLEMMGWISAY NGNTNYAQKLQGRVTMTDTSTSTAYMELSRLSRSDDTAVYYCARDEALVGATFDY WGQGTLVTVSS | ADI-19444 | Heavy chain variable region ("HC") amino acid sequence |
| Ab 155 | 310 | DIVMTQSPDSLAVSLGERATINCKSSQSVLYSSNNKNYLAWYQQKPGQPPKLLITW ASTRESVPDRFSGSGSGTDFTLTISSLQAEDVAVYYCQQYSTPRTFGQGTKVEIK | ADI-19445 | Light chain variable region ("LC") amino acid sequence |
| Ab 156 | 311 | EVQLVESGPGLVKPSGTLSLTCAVSGGSISSSNWWSWRQPPGKGLEWIGEIYHSG STNYNPSLKSRVTISVDKSKNQFSLKLSSVTAADTAVYYCARDVETDGYNYGYYFDY WGQGTLVTVSS | ADI-19445 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 156 | 312 | SYELIQPPSVSVAPGKTARITCGGNNIGSKSVHWYQQKPGQAPVLVVYDDSDRPSGIPGRFSGSNSGNTATLTISRVEAGDEADYYCQVWDSSSDHKVFGGGTKLTVL | ADI-19445 | Light chain variable region ("LC") amino acid sequence |
| Ab 157 | 313 | QVQLQESGPGLVKPSETLSLICTVSGGSISSSSYYMGWIRQPPGKGLEWICSIYYSGSTYYNPSLKSRVTISVDTSKNQFSLKLSSVTAADTAVYYCARDRVVTTYFDYWGQGTLVTVSS | ADI-19447 | Heavy chain variable region ("HC") amino acid sequence |
| Ab 157 | 314 | SYELTQPPSVSVSPGQTARITCSGDALPKKYAYWYQQKSGQAPVLVIYEDSKRPSGIPERFSGSSSGTMATLTISGAQVEDEADYYCYSTDSSGNHRVFGGGTKLTVL | ADI-19447 | Light chain variable region ("LC") amino acid sequence |
| Ab 158 | 315 | EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARELLDPGIAAAGFDYWGQGTLVTVSS | ADI-19448 | Heavy chain variable region ("HC") amino acid sequence |
| Ab 158 | 316 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLLSVNVFGTGTKVTVL | ADI-19448 | Light chain variable region ("LC") amino acid sequence |
| Ab 159 | 317 | EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARDSGSYLSYAFDIWGQGTMVTVSS | ADI-19449 | Heavy chain variable region ("HC") amino acid sequence |
| Ab 159 | 318 | SYELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVL | ADI-19449 | Light chain variable region ("LC") amino acid sequence |
| Ab 160 | 319 | EVQLLESGGGLVQPGGSLRLSCAASGFTFSSYWMHWVRQAPGKGLVWVSRINSDGSSTSYADSVKGRFTISRDNAKNTLYLQMNSLRAEDTAVYYCARAPISILRFLGGYFDYWGQGTLVTVSS | ADI-19450 | Heavy chain variable region ("HC") amino acid sequence |
| Ab 160 | 320 | EIVMTQSPSTLSASVGDRVTITCRASQSISSWLAWYQQKPGKAPKLLIYKASSLESGVPSRFSGSGSGTEFTLTISSLQPDDFATYYCQQYNSYSSFGQGTKLEIK | ADI-19450 | Light chain variable region ("LC") amino acid sequence |
| Ab 161 | 321 | EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARGYCSGGSCYSHYFQHWGQGTLVTVSS | ADI-19454 | Heavy chain variable region ("HC") amino acid sequence |
| Ab 161 | 322 | QSVLTQPASVSGSPGQSITISCTGTSSDVGGYNYVSWYQHPGKAPKLMIYDVSNRPSGVSNRFSGSKSGNTASLTIISGLQAEDEADYYCSSYTSSSTVVFGGGTKVTVL | ADI-19454 | Light chain variable region ("LC") amino acid sequence |
| Ab 162 | 323 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARSQSGSYYSSDYWGQGTLVTVSS | ADI-19455 | Heavy chain variable region ("HC") amino acid sequence |
| Ab 162 | 324 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKVTVL | ADI-19455 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 163 | 325 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCARQGYCSGGSCYHIDY WGQGTLVTVSS | ADI-19457 | Heavy chain variable region ("HC") amino acid sequence |
| Ab 163 | 326 | QSVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGWVFGGGTKLTVL | ADI-19457 | Light chain variable region ("LC") amino acid sequence |
| Ab 164 | 327 | EVQLVESGGGRVKPGGSLRLSCAASGFTFRSYSMNWVRQAPGKGLEWVSSISSSSS YINYADSVKGRFTISRDNAKNSLYLQMNSLRAEDTAVYYCARDGSGMTIFGVVIDY WGQGTLVTVSS | ADI-19458 | Heavy chain variable region ("HC") amino acid sequence |
| Ab 164 | 328 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDRSLTVVFGGGTKLTVL | ADI-19458 | Light chain variable region ("LC") amino acid sequence |
| Ab 165 | 329 | QVQLVESGGGLVQPGGSLRLSCAASGFTVSSNYMSWVRQAPGKGLEWVSVIYSG GSTYYADSVKGRFTISRDNSKNTLYLQMNSLRAEDTAVYYCAREALGMDHWYFDL WGRGTLVTVSS | ADI-19459 | Heavy chain variable region ("HC") amino acid sequence |
| Ab 165 | 330 | SYELMQPPSVSVAPGKTARITCGGNNIGSKSVHWYQQKPGQAPVLVVYDDSDRPS GIPERFSGSNSGNTATLTISRVEAGDEADYYCQVWDSSSDHPVFGGGTKVTVL | ADI-19459 | Light chain variable region ("LC") amino acid sequence |
| Ab 166 | 331 | QVQLQQWGAGLLKPSETLSLTCAVYGGSFSGGYYWSWIRQPPGKGLEWIGEINHSG STNYNPSLKSRVTISVDTSKNQFSLKLSSVTAADTAVYYCARGGITAYYYYGMDVW GQGTTVTVSS | ADI-19460 | Heavy chain variable region ("HC") amino acid sequence |
| Ab 166 | 332 | DIQMTQSPSSLSASVGDRVTITCRASQSISSYLNWYQQKPGKAPKLLIYAASSLQSG VPSRFSGSGSGTDFTLTISSLQPEDFATYYCQQSYSTPYTFGQGTKVEIK | ADI-19460 | Light chain variable region ("LC") amino acid sequence |
| Ab 167 | 333 | EVQLVESGGGLVKPGGSLRLSCAASGFTFSDYYMSWIRQAPGKGLEWVSISSSGS TIYYADSVKGRFTISRDNAKNSLYLQMNSLRAEDTAVYYCASSLIVTSRSDAFDIWG QGTMVTVSS | ADI-19461 | Heavy chain variable region ("HC") amino acid sequence |
| Ab 167 | 334 | QPGLTQLPSVSVAPGKTARITCGGNNIGSKSVHWYQQKPGQAPVLVVYDDSDRPS GIPERFSGSNSGNTATLTISRVEAGDEADYYCQVWDSSSDHVVFGGGTKLITVL | ADI-19461 | Light chain variable region ("LC") amino acid sequence |
| Ab 168 | 335 | QITLKESGPTLVKPTQTLTLTCTFSGFSLSTSGVGVGWIRQPPGKALEWLALIIYWDD DKRYSPSLKSRLTITKDTSKNQVVLTMTNMDPVDTATYYCAHAANMGYYFDYWG QGTLVTVSS | ADI-19462 | Heavy chain variable region ("HC") amino acid sequence |
| Ab 168 | 336 | DIVMTQSPSTLSASVGDRVTITCRASQSISSWLAWYQQKPGKAPKLLIYKASSLESG VPSRFSGSGSGTEFTLTISSLQPDDFATYYCQQYNSYWTFGQGTKVEIK | ADI-19462 | Light chain variable region ("LC") amino acid sequence |
| Ab 169 | 337 | QVQLQESGPGLVKPSQTLSLTCTVSGGSISSGDYYWSWIRQPPGKGLEWICYIYYSG STYYNPSLKSRVTISVDTSKNQFSLKLSSVTAADTAVYYCARDRLGIFDYWGQGTLVT VSS | ADI-19463 | Heavy chain variable region ("HC") amino acid sequence |
| Ab 169 | 338 | EIVLTQSPDSLAVSLGERATINCKSSQSVLYSSNNKNYLAWYQQKPGQPPKLLIYWA STRESGVPDRFSGSGSGTDFTLTISSLQAEDVAVYYCQQYYSTPWTFGQGTKVEIK | ADI-19463 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 170 | 339 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCAREGSSSWYYFDIYWGQ GTLVTVSS | ADI-19465 | Heavy chain variable region ("HC") amino acid sequence |
| Ab 170 | 340 | QSVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYVFGGGTKLTVL | ADI-19465 | Light chain variable region ("LC") amino acid sequence |
| Ab 171 | 341 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCASLSSSSELGYYFDIYWG QGTLVTVSS | ADI-19467 | Heavy chain variable region ("HC") amino acid sequence |
| Ab 171 | 342 | QPVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYVFGTGTKLTVL | ADI-19467 | Light chain variable region ("LC") amino acid sequence |
| Ab 172 | 343 | EVQLVESGPGLVKPSETLSLLCTVSGGSISSSSYYMGWIRQPPGKGLEWIGSIYYSGS TYYNPSLKSRVTISVDTSKNQFSLKLSSVTAADTAVYYCARRDGYNYGWFDPWGQG TLVTVSS | ADI-19468 | Heavy chain variable region ("HC") amino acid sequence |
| Ab 172 | 344 | NFMLTQPHSVSESPGKTVTISCTGSSGSIASNYVQWYQQRPGSAPTTVIYEDNQRP SGVPDRFSGSIDSSSNSASLTISGLKTEDEADYYCQSYDSSNVFGGGTKVTVL | ADI-19468 | Light chain variable region ("LC") amino acid sequence |
| Ab 173 | 345 | QVQLQESGPGLVKPSETLSLTCAVSGYSISSGYYWGWIRQPPGKGLEWIGSIYHSGS TYYNPSLKSRVTISVDTSKNQPSLKLSSVTAADTAVYYCARWTVMYYFDIYWGQGTL VTVSS | ADI-19469 | Heavy chain variable region ("HC") amino acid sequence |
| Ab 173 | 346 | EIVMTQSPATLSLSPGERATLSCRASQSVSSYLAWYQQKPGQAPRLLIYDASNRATG IPARFSGSGSGTDFTLTISSLEPEDFAVYYCQQRSNWPTFGGGTKLEIK | ADI-19469 | Light chain variable region ("LC") amino acid sequence |
| Ab 174 | 347 | EVQLLESGGGVVQPGRSLRLSCAASGFTFSSYGMHWVRQAPGKGLEWVAVISYD GSNKYYADSVKGRFTISRDNSKNTLYLQMNSLRAEDTAVYYCAKGRGDFWSGYGM DVWGQGTTVTVSS | ADI-19470 | Heavy chain variable region ("HC") amino acid sequence |
| Ab 174 | 348 | SYELTQPPSVSVSPGQTASITCSGDKLGDKYACWYQQKPGQSPVLVIYQDSKRPSGI PERFSGSNSGNTATLTISGTQAMDEADYYCQAWDSSTAVFGGGTKVTVL | ADI-19470 | Light chain variable region ("LC") amino acid sequence |
| Ab 175 | 349 | EVQLVESGGGLVQPGGSLRLSCSASGFTFSSYAMHWVRQAPGKGLEYVSAISSNG GSTYYADSVKGRFTISRDNSKNTLYLQMSSLRAEDTAVYYCVKADQSSGWFPDY WGQGTLVTVSS | ADI-19471 | Heavy chain variable region ("HC") amino acid sequence |
| Ab 175 | 350 | NFMLTQPHSVSESPGKTVTISCTRSSGSIASNYVQWYQQRPGSSPTTVIYEDNQRPS GVPDRFSGSIDSSSNSASLTISGLKTEDEADYYCQSYDSSNVFGGGTKLTVL | ADI-19471 | Light chain variable region ("LC") amino acid sequence |
| Ab 176 | 351 | EVQLVESGAEVKKPGESLKISCKGSGYSFTSYWIGWVRQMPGKGLEWMGIIYPGD SDTRYSPSFQQGVTISADKSISTAYLQWSSLKASDTAMYYCARLIAAAGIDYWGQG TLVTVSS | ADI-19473 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 176 | 352 | NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNIWVFGGGTKVTVL | ADI-19473 | Light chain variable region ("LC") amino acid sequence |
| Ab 177 | 353 | QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARPYSGSYYAFDIWGQGTTVTVSS | ADI-19474 | Heavy chain variable region ("HC") amino acid sequence |
| Ab 177 | 354 | NFMLTQPHSVSESPGKTVTISCTRSSGSIASNYVQWYQQRPGSSPTTVIYEDNQRPSGVPDRFSGSIDSSSNSASLTIISGLKTEDEADYYCQSYDSSNQVFGGGTKLTVL | ADI-19474 | Light chain variable region ("LC") amino acid sequence |
| Ab 178 | 355 | EVQLLESGAEVKKPGASVKVTCKASGYTFTHFGINWVRQAPGQGLEWLGWISAYNGNTNVYQKIQGRVTMTDTSTNTAYMELRSLRSDDTAVYYCARGPPVEAAGTFDYWGQGTLVTVSS | ADI-19475 | Heavy chain variable region ("HC") amino acid sequence |
| Ab 178 | 356 | DIVLTQSPLSLPVTLGQPASISCRSSQSLVVSDGNTYLITWFQQRPGQSPRRLIYKVSNRDSGVPDRFSGSGSGTDFTLQISRVEAEDVGVYYCMQGTHWPFTFGPGTKVEIK | ADI-19475 | Light chain variable region ("LC") amino acid sequence |
| Ab 179 | 357 | QVQLVESGPTLVKPTQTLTLTCTFSGFSLSTSRVGVWIRQPPGKALEWLALIIYWDDDKRYSPSLKSRLTITKDTSKNQVVLTMTNMDPVDTARYYCAHRSTYDILGGYYFDYWGQGTLVTVSS | ADI-19476 | Heavy chain variable region ("HC") amino acid sequence |
| Ab 179 | 358 | QPVLTQPRSVSGSPGQSVTISCTGTSSDVGGYNYVSWFQQHPGKAPKLMIYDVSKRPSGVPNRFSGSKSGNTASLTISGLQAEDEADYFCCSYAGTYEVFGGGTKLTVL | ADI-19476 | Light chain variable region ("LC") amino acid sequence |
| Ab 180 | 359 | QVQLVESGPGVVKPSETLSLICTVSGGPVSRSYWGWIRQPPGKGLEWIGSIYYSGSTYYNTSLKSRVTISVDTSKNQFSLKLSSVTAADTAVYYCAKLQYSTSGFDYWGQGTLVTVSS | ADI-19478 | Heavy chain variable region ("HC") amino acid sequence |
| Ab 180 | 360 | QPVLTQPPSVSEAPRQRVTISCSGSSSNIGNNAVSWYQQLPGKAPKLLIYDDLVPSGVSDRFSGSKSGTSASLAISGLQSEDEADYYCAAWDDSLNGVVFGGGTKLTVL | ADI-19478 | Light chain variable region ("LC") amino acid sequence |
| Ab 181 | 361 | QVQLVQSGAEVKKPGSSVKVSCKASGGTFSSNAIINWVRQAPGQGLEWMGGIIPIFGTANYAQKFQGRVTITTDESTSTAYMELSSLRSEDTAVYYCATTFYYGSGADYWGQGTLVTVSS | ADI-19479 | Heavy chain variable region ("HC") amino acid sequence |
| Ab 181 | 362 | DIQMTQSPLSLPVTLGQPASISCRSSQSLVVSDGNMYLSWFQQRPGQSPRRLIYKVSNRDSGVPDRFSGSGSGTDFTLKISRVEAEDVGVYYCMQGTHWWTFGQGTKVEIK | ADI-19479 | Light chain variable region ("LC") amino acid sequence |
| Ab 182 | 363 | EVQLVESGGGLVKPGGSLRLSCAASGFTFSAYSMNWVRQAPGKGLEWVSSISSTTNYISYADSVKGRFTISRDNAKNSLYLQMNSLRAEDTAVYYCARDPKYYGLGTYYKDDYWGQGTLVTVSS | ADI-19480 | Heavy chain variable region ("HC") amino acid sequence |
| Ab 182 | 364 | NFMLTQPHSVSESPGKTVTISCTRSSGSIASNYVQWYQQRPGSSPTTVIYEDNQRPSGVPDRFSGSIDSSFNSASLTIVSGLKTEDEADYYCQSFDNNNRWVFGGGTKLTVL | ADI-19480 | Light chain variable region ("LC") amino acid sequence |
| Ab 183 | 365 | EVQLVESGGVVVQPGGSLRLSCAASGFTFDDYTMHWVRQAPGKGLEWVSLIISWDGGITYYADSVKGRFTISRDNSKNSLYLQMNSLRTEDTALYYCVKGGYYDGSGYYYFDYWGQGTLVTVSS | ADI-19481 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 183 | 366 | DIQMTQSPSSLSASVGDRVTVTCRASQSISSYLNWYQHKPGNAPKLLIYAASSLQSGVPSRFSGSGSGTDFTLTISSLQPEDFATYYCQQSYSTPYIFGQGTKVEIK | ADI-19481 | Light chain variable region ("LC") amino acid sequence |
| Ab 184 | 367 | QVQLQQWGAGLLKPSETLSLTCGAFHGSFSGYYWSWIRQPPGKGLEWIGEVTHSRSTNYNPSLKSRITISVDTSRNQFSLKLNSVTAADTAVYYCARGSGEWYFDIWGRGTLVTVSS | ADI-19482 | Heavy chain variable region ("HC") amino acid sequence |
| Ab 184 | 368 | DIQLTQSPSTLSASVGDRVTITCRASQSISSWLAWYQQKPGKGRAPKLLIYKASSLESGVPSRFSGSGSGTEFTLTISSLQPDDFATYYCQQYNSYSPEIFGQGTKVEIK | ADI-19482 | Light chain variable region ("LC") amino acid sequence |
| Ab 185 | 369 | QVQLVQSGAEVKKPGESLKISCKGSGYSFTTYWIGWVRQMPGKGLEWMGIIFPGDSDTRYSPSFQGQVTISADKSISTAYLQWSSLKASDTAMYFCARSAPPFGFDIWGQGTMVTVSS | ADI-19483 | Heavy chain variable region ("HC") amino acid sequence |
| Ab 185 | 370 | SYVLTQPHSVSESPGKTVTISCTRSSGSIASNYVQWYQQRPGSSPTTVIYEDHQRPSGVPDRFSGSIDSSSNSASLTISGLQTEDEADYYCQSYGSGNPWVFGGGTKVTVL | ADI-19483 | Light chain variable region ("LC") amino acid sequence |
| Ab 186 | 371 | QVQLQESGSGLVKPSQTLSLTCVSVSGGSISSGNMSWIRQPPGKGLEWIGYIYDSGNTYYNPSLKSRVTISVDRSKNQFSLKVSSVTAADTAVYYCARGAETGTTGWYDPWGQGTLVTVSS | ADI-19484 | Heavy chain variable region ("HC") amino acid sequence |
| Ab 186 | 372 | DIRLTQSPSSLSASVGDRVTITCRASQTISSYLNWYQQKPGKAPRLLIYAASSLQSGVPSRFSGSGSGTDFTLTISSLQPEDFATYYCQQSYGTPRTFGQGTKVEIK | ADI-19484 | Light chain variable region ("LC") amino acid sequence |
| Ab 187 | 373 | QVQLQESGPGLVKPSQTLSLCTVSGGSISSTNYYMTWIRQHPGKGLEWIGFIYNRGSTYYNPSLTSRVTISRVTISRNQFSLKLTSVTAADTAVYYCARAPYYDRNGYYTAFDIWGQGTTVTVSS | ADI-19485 | Heavy chain variable region ("HC") amino acid sequence |
| Ab 187 | 374 | EIVLTQSPATLSVSPGERATLSCRASQSVSSNLAWYQQKPGQAPRLLIYDASTRATDIPARFSGGGSGTFTLTISSLQSEDFAVYYCQQYNNWPRTFGLGTKVDIK | ADI-19485 | Light chain variable region ("LC") amino acid sequence |
| Ab 188 | 375 | QVQLQESGPGLVKPSETLSLTCSVSGGSLTSYYWSWIRQPPGKGLEWIGYIYYSGSTNYNPSLKSRLTISVDTSKNQFSLKLSSVTAADTAVYYCARVGGRGVINVFDYWGQGTLVTVSS | ADI-19486 | Heavy chain variable region ("HC") amino acid sequence |
| Ab 188 | 376 | QPVLTQPASVSGSPGQSITISCTGTSSDVGGYNYVSWYQQHPGKAPKLMIYEVSNRPSGVSNRFSGSKSGNTASLTISGLQAEDEADYYCCDSYRSNSASVVFGGGTKLTVL | ADI-19486 | Light chain variable region ("LC") amino acid sequence |
| Ab 189 | 377 | QVTLKESGPALVKPTQTLTLTCTFSGLSISTSGMCVSWIRQPPGKALEWLARIDWDDDKYYSTSLKTRLTISKDTSKNQVVLTMTNMDPVDTATYYCARINYYDSSGYYVYFDYWGQGTLVTVSS | ADI-19487 | Heavy chain variable region ("HC") amino acid sequence |
| Ab 189 | 378 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPPFTFGPGTKVDIK | ADI-19487 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 190 | 379 | QVQLVQSGAEVKKPGASVKVSCKVSGYTLTELSMHWVRQAPGKGLEWMGGFDP EDGETIYAQKFQGRVTMTEDTSTDTAYMELSSLRSEDTAVYYCATARFLEWLSGTN WFDPWGQGTLVTVSS | ADI-19488 | Heavy chain variable region ("HC") amino acid sequence |
| Ab 190 | 380 | DIQLTQSPLSLPVTPGEPASISCRSSQSLLHSNGYNYLDWYLQKPGQSPQLLIYLGSN RASGVPDRFSGSGSGTDFTLKISRVEAEDVGVYYCMQALQTPFTGGGTKVEIK | ADI-19488 | Light chain variable region ("LC") amino acid sequence |
| Ab 191 | 381 | QITLKESGPALVKPTQTLTLTCTFSGFSLSTSGMCVSWIRQPPGKALEWLARIDWDD DKYYSTSLKTRLTISKDTSKNQVVLTMTNMDPVDTATYYCARMCWGNYVPIDAFDI WGQGTMVTVSS | ADI-19489 | Heavy chain variable region ("HC") amino acid sequence |
| Ab 191 | 382 | DIQLTQSPSSLSASVGDRVTITCRASQGIRNDLGWYQQKPGKAPKRLIYAASSLQSG VPSRFSGSGSGTEFTLTISSLQPEDFATYYCLQHNSYPPTFGQGTKVDIK | ADI-19489 | Light chain variable region ("LC") amino acid sequence |
| Ab 192 | 383 | EVQLVESGGGLVKPGGSLRLSCAASGFTFSNAWMSWVRQAPCKGLEWVGRIKSK TDGGTTDYAAPVKGRFTISRDDSKNTLYLQMNSLKTEDTAVYYCTTDSSSGGMDV WGQGTTVTVSS | ADI-19490 | Heavy chain variable region ("HC") amino acid sequence |
| Ab 192 | 384 | DIVLTQSPLSLPVTPGEPASISCRSSQSLLHSNGYNYLDWYLQKPGQSPQLLIYLGSN RASGVPDRFSGSGSGTDFTLKISRVEAEDVGVYYCMQALQTPLTFGGGTKVDIK | ADI-19490 | Light chain variable region ("LC") amino acid sequence |
| Ab 193 | 385 | QVQLVQSGPTLVKPTQTLTLTCTFSGFSLSTSGVGVWIRQPPGKALEWLALIYWD DDKRYSPSLKSRLTITIKDTSKNQVVLTMTNMDPVDTATYYCAHRRATTVTTGYFDY WGQGTLVTVSS | ADI-19491 | Heavy chain variable region ("HC") amino acid sequence |
| Ab 193 | 386 | QSVLTQPPSVSGAPGQRVTISCTGSSNIGAGYDVHWYQQLPGTAPKLLIYGNSNR PSGVPDRFSGSKSGTSASLAITGLQAEDEADYYCQSYDSSLSGHVFGTGTKVTVL | ADI-19491 | Light chain variable region ("LC") amino acid sequence |
| Ab 194 | 387 | QVQLVQSGAEVKKPGESLKISCKGSGYRFTSYWIGWVRQMPGKGLEWMGIIYPG DSDTRYSPSFQGQVTISADKSISTAYLQWSSLKASDTAMYYCARSGSHYAPDLWGQ GTMVTVSS | ADI-19492 | Heavy chain variable region ("HC") amino acid sequence |
| Ab 194 | 388 | NFMLTQPHSVSESPGKTVTISCTRSSGNIASNYVQWYQQRPGSSPTTVLYEDNQRP SGVPDRFSGSIDSSSNSASLITISGLKTEDEADYYCQSYDSSNPWVFGGGTKLTVL | ADI-19492 | Light chain variable region ("LC") amino acid sequence |
| Ab 195 | 389 | QVQLQQWGAGLLKPSETLSLTCAVYGGSFSGYYWSWIRQPPCKGLEWIGEINHSG STNYNPSLKSRVTISVDTSKNQFSLKLSSVTAADTAVYYCARLIENTRVGEYYFDYWG QGTLVTVSS | ADI-19493 | Heavy chain variable region ("HC") amino acid sequence |
| Ab 195 | 390 | SYELTQPPSVSVSPGQTASITCSGDKLGDKYACWYQQKPGQSPVLVIYQDSKRPSGI PERFSGSNSGNTATLTISGTQAMDEADYYCQAWDSSTVVFGGGTQLTVL | ADI-19493 | Light chain variable region ("LC") amino acid sequence |
| Ab 196 | 391 | QVQLVQSGAEVKKPGSSVKVSCKASGGTFSSYVISWVRQAPGQGLEWMGGIIPIF GTTYYAQKFQDRVTITTDESTSTAYMELSSLRSEDTAVYYCARDLRYRNAYDGADA FDIWGQGTTVTVSS | ADI-19494 | Heavy chain variable region ("HC") amino acid sequence |
| Ab 196 | 392 | QSALTQPASVSGSPGQSITISCTGTSSDVGGYNYVSWYQQHPGKAPKLMIFEVSNR PSGVSNRFSGSKSGNTASLTISGLQAEDEADYYCTSYTKSNSVVFGGGTKLTVL | ADI-19494 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 197 | 393 | QVQLQESGPGLVKPSETLSLTCTVSGGSISSYYWSWIRQPPGKGLEMIGYIYTSGST NYNPSLKSRVTISVDTSKNQFSLKLSSVTAADTAVYYCARVGSYYDLQHWGQGTLV TVSS | ADI-19495 | Heavy chain variable region ("HC") amino acid sequence |
| Ab 197 | 394 | DIQLTQSPSSVSASVGDRVTITCRASQGISMLAWYQQKPGKAPKLLIYAASSLQSG VPSRFSGSGSGTDFTLTISSLQPEDFATYYCQQANSFPLITFGGGTKVEIK | ADI-19495 | Light chain variable region ("LC") amino acid sequence |
| Ab 198 | 395 | EVQLVESGGGVVQPGGSLRLSCAASGFTFSSYGMHWVRQAPGKGLEMVAFIRYD GSNKYYADSVKGRFTISRDNSKSTLYLQMNSLRAEDTAVYYCAKDATFGYSSSWYN FDYWGQGTLVTVSS | ADI-19496 | Heavy chain variable region ("HC") amino acid sequence |
| Ab 198 | 396 | DIQMTQSPDSLAVSLGERATINCKSSQSVLFSSNNKNYLAWYQQKPGQPPKLLIYW ASTRESGVPDRFSGSGSGTDFTLTISSLQAEDVAVYYCQQYYSTPTFGQGTKVEIK | ADI-19496 | Light chain variable region ("LC") amino acid sequence |
| Ab 199 | 397 | QVQLVQSGAEVKKPGASVKVSCKASGYTFTSYYMHWVRQAPGQGLEWMGIINPS GGSTSYAQKFQGRVTMTRDTSTSTVYMELSSLRSEDTAVYYCSRGYSYGYDYWGQ GTLVTVSS | ADI-19497 | Heavy chain variable region ("HC") amino acid sequence |
| Ab 199 | 398 | NFMLTQPHSVSESPGKTVTISCTRSSGSIASNYVQWYQQRPGSSPTTVIYEDNQRPS GVPDRFSGSIDSSSNSASLTISGLKTEDEADYYCQSYDSSNMVFGGGTKLTVL | ADI-19497 | Light chain variable region ("LC") amino acid sequence |
| Ab 200 | 399 | EVQLVESGGGLVQPGGSLRLSCAASGFTVSSNYMSWVRQAPGKGLEMVSVIYSGG SAYYADSVKGRFTISRDNSKNTLYLQMNSLRAEDTAVYYCAREARISPPQGAFDIW GQGTMVTVSS | ADI-19498 | Heavy chain variable region ("HC") amino acid sequence |
| Ab 200 | 400 | SYVLTQPPSVSVSPGQTARITCSGDALPKQYAYWYQQKPGQAPVLVIYKDSERPSGI PERFSGSSSGTTVTLTISGVQAEDEADYYCQSADSSGTLYVFGTGTKVTVL | ADI-19498 | Light chain variable region ("LC") amino acid sequence |
| Ab 201 | 401 | EVQLLESGPGLVKPSETLSLTCTVSGGSISSSSYYMGWIRQPPGKGLEWIGSIYYGS TYYNPSLKSRVTISVDTSKNQFSLKLSSVTAADTAVYYCAVLLYSSSSFDYWGQGTLV TVSS | ADI-19499 | Heavy chain variable region ("HC") amino acid sequence |
| Ab 201 | 402 | NFMLTQPHSVSESPGKTVTISCTRSSGSIASNYVQWYQQRPGSSPTTVIYEDNQRPS GVPDRFSGSIDSSSNSASLTISGLKTEDEADYYCQSYDSSNQAVFGGGTQLTVL | ADI-19499 | Light chain variable region ("LC") amino acid sequence |
| Ab 202 | 403 | EVQLVESGGGLVQPGGSLRLSCAASGFTFSSYSMNWVRQAPGKGLEMVSYISSSSS TIYYADSVKGRFTISRDNAKNSLYLQMNSLRAEDTAVYYCARGNTVTTFLDYWGQ TLVTVSS | ADI-19500 | Heavy chain variable region ("HC") amino acid sequence |
| Ab 202 | 404 | DIRLTQSPSFSASTGDRVTITCRASQGISSYLAWYQQKPGKAPKLLIYAASTLQSGV PSRFSGSGSGTDFTLTISCLQSEDFATYYCQQYYSYPPLITFGGGTKVDIK | ADI-19500 | Light chain variable region ("LC") amino acid sequence |
| Ab 203 | 405 | QVQLVQSGAEVKKPGASVKVSCKASGVAFTNYGVSWVRQAPGQGLEMMGWISV YNGNTNYAQKLQGRVTMTTDTSTSTAYMELRSLRSDDTALYYCARDPPSEGAAGL FDYWGQGTLVTISS | ADI-19501 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 203 | 406 | DIVMTQSPLSLPVTLGQPASFSCRSSQSLVYSDGNTYLSWFQQRPGQSPRRLIYKVS NRDSGVPDRFSGSGSGTDFTLKISRVEAEDVGVYYCMQGTHWPCTFGQGTKVEIK | ADI-19501 | Light chain variable region ("LC") amino acid sequence |
| Ab 204 | 407 | EVQLVESGGGVVQPGGSLRLSCAASGFTFSSDGMHWVRQAPGKGLEWVAFIQYD GTNKYYVDSVKGRFTISRDNSKNTLYLQMNSLRAEDTAVYYCAKDQGFRYSSSWYA FDIWGQGTMVTVSS | ADI-19502 | Heavy chain variable region ("HC") amino acid sequence |
| Ab 204 | 408 | EIVMTQSPDSLAVSLGERATINCKSSQSVLFNSNNKNYLAWYQQKPGQPPKLLIYW ASTRESGVPDRFSGSGSGTDFTLTISSLQAEDVAVYYCQQYYSTPIFGQGTRLEIK | ADI-19502 | Light chain variable region ("LC") amino acid sequence |
| Ab 205 | 409 | QVQLVQSGAEVKKPGASVKVSCKASGYTFTSYYMHWVRQAPGQGLEWMGIINPS GGSTSYAQKFQGRVTMTRDTSTSTVMELSSLRSEDTAVYYCARDSLVNCSGGSCP GGPDYWGQGTLVTVSS | ADI-19503 | Heavy chain variable region ("HC") amino acid sequence |
| Ab 205 | 410 | SYVLTQPPSVSVSPGQTARITCSGDALPKKYAYWYQQKSGQAPVLVIYEDSKRPSGI PERFSGSSSGTMATLTISGAQVEDEADYYCYSTDSSGNHRVFGGGTKLTVL | ADI-19503 | Light chain variable region ("LC") amino acid sequence |
| Ab 206 | 411 | QVQLVQSGAEVKKPGESLKISCKGSGYSFTNYWIGWVRQMPGKGLEWMGIIYPG DSDTRYSPSFQGQVTISADKSISTAHLQWDSLKASDTAMYCARLRCTGSICYDAFD IWGQGTTVTVSS | ADI-19505 | Heavy chain variable region ("HC") amino acid sequence |
| Ab 206 | 412 | SYVLTQPLSVSVALGQTARITCGGNNIGSKNVHWYQQKPGQAPVLVIYRDNNRPS GIPERFSGSNSGNTATLTISRAQAGDEADYYCQVWDSSTGGDVFGAGTKVTVL | ADI-19505 | Light chain variable region ("LC") amino acid sequence |
| Ab 207 | 413 | QVQLVQSGAEVKKPGASVKVSCKASGYTFTSYGISWVRQAPGQGLEWMGWISAY NGNTNYAQKLQGRVTMTDTSTSTAYMELRSLRSDDTAVYYCARVRSVGRPGELL YYYYGMDVWGQGTTVTVSS | ADI-19506 | Heavy chain variable region ("HC") amino acid sequence |
| Ab 207 | 414 | DIRLTQSPLSLPVTPGEPASISCRSSQSLLHSNGYNYLDWYLQKPGQSPQLLIYLGSN RASGVPDRFSGSGSGTDFTLKISRVEAEDVGVYYCMQALQTPWTFGQGTKLEIK | ADI-19506 | Light chain variable region ("LC") amino acid sequence |
| Ab 208 | 415 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCAREVLTGDYLGWFDPW GQGTLVTVSS | ADI-19507 | Heavy chain variable region ("HC") amino acid sequence |
| Ab 208 | 416 | QSVVTQPPSVSGAPGQRVTISCTGSSNIGAGYDVHWYQQLPGTAPKLLIYGNSNR PSGVPDRFSGSKSGTSASLAITGLQAEDEADYYCQSYDSSHWVFGGGTKLTVL | ADI-19507 | Light chain variable region ("LC") amino acid sequence |
| Ab 209 | 417 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCASSRRSLTGDRGGWFD PWGQGTLVTVSS | ADI-19509 | Heavy chain variable region ("HC") amino acid sequence |
| Ab 209 | 418 | QSVLTQPPSVSGAPGQRVTISCTGSSNIGAGYDVHWYQQLPGTAPKLLIYGNSNR PSGVPDRFSGSKSGTSASLAITGLQAEDEADYYCQSYDSSLSGWVFGGGTKLTVL | ADI-19509 | Light chain variable region ("LC") amino acid sequence |
| Ab 210 | 419 | EVQLVESGGGLVKPGGSLRLSCAASGFSLSSYYMNWVRQAPGKGLEWVSSISSSST YINYADSVKGRFTINYADSVKGRFTISRDNAKNSLYLQMNSLRAEDTAVYYCARGGSITIFGVVFDSWG QGTLVTVSS | ADI-19510 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 210 | 420 | SYELTQPPSVSGAPGQRVTISCTGTSSNIGAGYDVHWYQQLPGTAPKLLIYNSNRP SGVPDRFSGSKSGTSASLAITGLQAEDEADYYCQSYDSSLSGGVFGTGTKVTVL | ADI-19510 | Light chain variable region ("LC") amino acid sequence |
| Ab 211 | 421 | QITLKESGPTLVKPTQTLTLTCTFSGFSLSTSGVGVGWIRQPPGKALEWLALIYWDD DKRYSPSLKSRLTITKDTSKNQVVLTMTNMDPVDTATYYCAHSVYDFWSGYYVPN YFDYWGQGTLVTVSS | ADI-19511 | Heavy chain variable region ("HC") amino acid sequence |
| Ab 211 | 422 | DIQMTQSPSSLSASVGDRVTITCRASQGIRNDLGWYQQKPGKAPKRLIYAASSLQS GVPSRFSGSGSGTEFLTISSLQPEDFATYYCLQHNSYPLTFGGGTKVEIK | ADI-19511 | Light chain variable region ("LC") amino acid sequence |
| Ab 212 | 423 | EVQLLESGAEVKKPGASVKVSCKTSGYTFSNYGVSWVRQAPGQGLEWMGWISAYN GNTNYAQKLQGRVTMTTDSSTSTAYMEVRSLRSDDTAVYYCARDVAPVAASLFDY WGQGTLVTVSS | ADI-20959 | Heavy chain variable region ("HC") amino acid sequence |
| Ab 212 | 424 | DIRLTQSPLSLPVTLGQPASISCRSSQSLEFTDGNTYLSWFQQRPGQSPRRLIYKVSN RDSGVPDRFSGSGSGTDFTLKINRVEAEDVGVYYCMQGIHWPPTFGPGTKVEIK | ADI-20959 | Light chain variable region ("LC") amino acid sequence |
| Ab 213 | 425 | QVQLQQWGAGVLKPSETLSLTCAVNGRSLSGHYWSWIRQTPGKGLEWIGEINNS GGTHYSPSLKSRVIISGDTAKNQLSLKLSSVTAADTAVYYCAKGSAEWYFDLWGRGT LVTVSS | ADI-20960 | Heavy chain variable region ("HC") amino acid sequence |
| Ab 213 | 426 | DIRVTQSPSTLSASVGDRVTITCRASQSVSTWLAWYQQKPGKPPSLLIFKASTLESGV PSRFSGSGSGTEFTLTISSLQPDDFATYYCQQYNTYSPWTFGPGTKVEIK | ADI-20960 | Light chain variable region ("LC") amino acid sequence |
| Ab 214 | 427 | QVQLVESGGGLVKPGGSLRLSCAASGFKFSSYYMHWVRQAPGKGLEMVSSVSGG STYTSYADSVKGRFTISRDNAKHSLFLQLNSLRAEDTAVYHCVRGDYHPSGTSLNWF DPWGQGTLVTVSS | ADI-20961 | Heavy chain variable region ("HC") amino acid sequence |
| Ab 214 | 428 | QPGLTQPPSVSGAPGQRVTISCTGSSNIGAGYDVHWYKQLPGTVPKLLIYANNNR PSGVPDRFSGSGSGTSASLAITGLQAEDEADYYCQSYDSSLNAYVFGTGTKVTVL | ADI-20961 | Light chain variable region ("LC") amino acid sequence |
| Ab 215 | 429 | QVQLVQSGAEVKKPGASVKVSCKAASGYTFSHYGLSWVRQAPGQGLEWMGWISA YNHNTNYAQKFQGRVTITTDITSTSTAYLEMRSLRSDDTAVYYCAREPPSDTAAGTG DYWGQGTLVTVSS | ADI-20962 | Heavy chain variable region ("HC") amino acid sequence |
| Ab 215 | 430 | DIVMTQSPLSLSVTLGQPASISCRSSQSLVYSDGNTYLTWFQQRPGQSPRRLIYKVS NRDSGVPDRFSGSGSGTDFTLKISRVEAEDVGVYYCMQGTQMPRTFGQGTKVDIK | ADI-20962 | Light chain variable region ("LC") amino acid sequence |
| Ab 216 | 431 | EVQLVESGGGLAKPGGSLRLSCAASGFTFSHYNMNWVRQAPGKGLEMVSSISSTG FHIYYADSVKGRFVISRDNAENSLHLQMNSLRADDTGLYYCVRAEEYYYGSGSAGHY FDSWGQGTLVTVSS | ADI-20963 | Heavy chain variable region ("HC") amino acid sequence |
| Ab 216 | 432 | SYVLTQPPSVSVAPGHTAKITCGGSIIGTKSVHWYQQKPGQAPVLVVYDDSDRPSGI PERLSGSRSGNTATLTITRVEAGDEADYYCQVWDSSSEHAGVFGGGTKLTVL | ADI-20963 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 217 | 433 | QVQLVQSGAEVKKPGASVKVSCKASGYTFTHYGISWVRQAPGQGLEMWGWISAY NGNTNYAQKLQGRVTMTDTSTSTAYMEVRSLRYDDTAVYYCARDVPVEAATSPE FWGQGTLVTVSS | ADI-20964 | Heavy chain variable region ("HC") amino acid sequence |
| Ab 217 | 434 | DIVMTQTPLSLPVTLGQPASISCRSSQSLVVSDGNTYLSWFQQRPGQSPRRLIYKVS NRDSGVPNRFSGSGSGTDFTLKISRVEAEDVGVYYCVQNTHWPAYTPGQGTKVEIK | ADI-20964 | Light chain variable region ("LC") amino acid sequence |
| Ab 218 | 435 | QVQLVQSGAEVKKPGASVKVSCKASGYNFTNYGISWVRQAPGQGLEMMGWIST SNGNTHYAQKSQGRITLTTDTISTNTAYMEVRSLRSDDTAVYYCAREGPESTYDWY HFDSWGQGTLVTVSS | ADI-20965 | Heavy chain variable region ("HC") amino acid sequence |
| Ab 218 | 436 | QSVVTQPPSVSVAPGQTAKITCGGNNIGSKTVHWYQLKAGQAPVLVVYDDSDRPS GIPERFSGSNSGNTATLTIRRVEAGDEADYPCQVWESASDHWVFGGGTKLTVL | ADI-20965 | Light chain variable region ("LC") amino acid sequence |
| Ab 219 | 437 | EVQLLESGGLGKPGGSLRLSCAASGFKLSSYYMHNVRQAPGKGPEWVSSISASSS YINYADSVRGRFTVSRDNAKNSLFLQMNSLRVDDTAIYYCARGAPLTNFGMVLDS WGQGTLVTVSS | ADI-20966 | Heavy chain variable region ("HC") amino acid sequence |
| Ab 219 | 438 | QSVLTQPPSVSGAPGQRVTISCTGSSNIGAGYDVHWYQQVPGRVPKLLIYANNN RPSGVPDRFSGSKSGTSASLAITGLQADDEADYCQSYDRSLNVVFGGGTKLTVL | ADI-20966 | Light chain variable region ("LC") amino acid sequence |
| Ab 220 | 439 | EVQLVESGGGVVQPGRSVRLSCAASGFSFSSYALHWVRQAPGKGLEMVGVIWYEE SNKYYADPVKGRFTISRDNSKNTLYLQMNSLRDEDTAVYYCARKGVATAGLDYWG QGTLVTVSS | ADI-20967 | Heavy chain variable region ("HC") amino acid sequence |
| Ab 220 | 440 | EIVLTQSPLSLPVTPGEPASISCRSSQSLLNSNGINYLDWYLQKPGQSPQLLIYLGSNR ASGVPDRFSGSGSGTDFTLKISRVEAEDVGVYYCMQALQTPQTFGPGTKVDIK | ADI-20967 | Light chain variable region ("LC") amino acid sequence |
| Ab 221 | 441 | QVQLQQWGAGLLKPSETLSLTCAMYGGSFSDDYWSWIRQPPGKGLEWIGEVNH GGSTNYNTSLKSRVTISADTSKKQFSLKLRSVTAADTAVYFCARGHRYCNATTCYSK AFDIWGQGTMVTVSS | ADI-20968 | Heavy chain variable region ("HC") amino acid sequence |
| Ab 221 | 442 | DIQMTQSPSSLSASVGDRVTITCQASQDIDIYLIWYQQKPGRAPKLLIYDASNLKTGV PSRFSGSGSGTEFTFTINNLQPEDFATYYCQQFHDLPLITFGGGTKLEIK | ADI-20968 | Light chain variable region ("LC") amino acid sequence |
| Ab 222 | 443 | EVQLVESGGGLVKPGGSLRLSCAASGFKFSSYTMNWVRQAPGKGLEMVSSVSASS SYIFYADSVQGRFIISRDNAQNSLYLQMNSLRADDTAVYYCARDQYGPGHYNPA WFDPWGQGTLVTVSS | ADI-20969 | Heavy chain variable region ("HC") amino acid sequence |
| Ab 222 | 444 | QPVLTQPPSVSGAPGQRVTISCTGTSSNIGAGYDVHWYKQLPGTAPKVLIYGNTNR PSGIPDRFSGSKSGTSASLAITGLKAEDEADYCQSYDRSGSKVFGTGTKLTVL | ADI-20969 | Light chain variable region ("LC") amino acid sequence |
| Ab 223 | 445 | EVQLLESGGGLVKPGGSLRLSCAVSGFSFSNAWMSWVRQAPGKGLEMWGRIRSKT DGGTTDYAAPVKGRFTISRDDSKNTLYLQMNSLKTEDTAVYYCTTAPRYSTWYPG YYYYYMDVWGKGTTVTVSS | ADI-20970 | Heavy chain variable region ("HC") amino acid sequence |
| Ab 223 | 446 | DIQMTQSPSSLSASVGDRVTITCQASQDINFYLNWYQQKPGKAPKLLIYDASNLETG VPSRFSSSVSGTDFTFTISSLQPEDFATYYCQQYDDLPAFGGGTKVEIK | ADI-20970 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 224 | 447 | EVQLVESGGGLVKPGESLRLSCAASGFTFSDYSMTWIRQAPGKLLEWIAYINSQS NYMDYADSVKGRFTISRDNAKNSLYLQMNGLRADDTAVYFCARDRRTFVAATLG WFDPWGQGTLVTVSS | ADI-20971 | Heavy chain variable region ("HC") amino acid sequence |
| Ab 224 | 448 | ETTLTQSPATLSVSPGERATLSCRASQSVSNNVAWYQQKPGQAPRVLIYAASTRAT GIPARFSGSESGTEFTLTISSLQSEDFAVYYCQQYNNWPRTFGQGTKLEIK | ADI-20971 | Light chain variable region ("LC") amino acid sequence |
| Ab 225 | 449 | QVQLQQWGAGLLRPSETLSLTCAVSGGSFSGHYWSWIRQPPGKGLEWIGGIINHS GNTNYSPSLRSRVTMSVDTSRNQFSLMLRSVTAADTAVYFCARNVPNLYGDYPRW FDPWGQGTLVTVSS | ADI-20972 | Heavy chain variable region ("HC") amino acid sequence |
| Ab 225 | 450 | QSVLTQPASVSGSPGQSITISCTGTSSDVGGFNYVSWYQHPGKAPKLMIYDVNN RPSGASNRFSGSKSGNTASLTISGLQAEDEADYYCSSYRSSDTLYFGTGTKVTVL | ADI-20972 | Light chain variable region ("LC") amino acid sequence |
| Ab 226 | 451 | EVQLLESGGGLVKPAGSLRLSCAASGFSSYYMMWIRQAPGKGLEWVSDISGGSS YTNYADSVKGRFTVSRDNAKNSVYLQMNSLRGEDTAVYYCARGASTAATYTPTFD YWGQGILVTVSS | ADI-20973 | Heavy chain variable region ("HC") amino acid sequence |
| Ab 226 | 452 | QPVLTQPPSVSGAPGQRVTISCTGSSSNIGAGYDVHWYQQLPGTAPKLLMPGNNN RPSGVPDRFSGSKSGTSASLAITGLRPEDEADYYCQSYDRRLTVVFGGGTKLTVL | ADI-20973 | Light chain variable region ("LC") amino acid sequence |
| Ab 227 | 453 | EVQLVESGGGLVKPGGSLRLSCAASGFSSSYQINWVRQAPGKGLEWVSSISGGSS YTDYADSIKGRFTISRDNAKKSAFLQMKSLRADDTAVYYCARALMATAGGLAFDIW GQGTMVTVSS | ADI-20974 | Heavy chain variable region ("HC") amino acid sequence |
| Ab 227 | 454 | QPVLTQPPSVSGAPGQRVTISCTGSGNIGAGYDVHWYQQVPGTAPKLLILRNTNR PSGVPDRFSGSKSGTSASLAITGLQAEDEADYYCQSYDRSLSVVFGGGTKLTVL | ADI-20974 | Light chain variable region ("LC") amino acid sequence |
| Ab 228 | 455 | QVQLVESGTHVKKPGASVKVSCEASDDTFNNKGIVWVRQAPGQGLEWMGWIRP NNGNTKYAQKFQGRVTMTTDASTNTAYMELRSLRSGDTAVYYCAREQFKWNDFY FDYWGQGILVTVSS | ADI-20975 | Heavy chain variable region ("HC") amino acid sequence |
| Ab 228 | 456 | SYELMQPPSVSVAPGQTATITCGGSNIGSETVHWYQQKPGQAPVLVVHDDTDRPS GIPERFSGSNSGNTATLTISGVEAGDEADFYCQVRDSRTDDVVFGGGTKLTVL | ADI-20975 | Light chain variable region ("LC") amino acid sequence |
| Ab 229 | 457 | QVQLVESGGDLVQKGGSLRLSCAASGFTFDNYAMTWIRQAPGQGLEMVSTVSGF VLGTGYTTYYADSVKGRFTISRDSSKNTVYIQLNSLRAEDTAVYYCAKCAATRNECL WDYLQQWGQGTTVTVSS | ADI-20976 | Heavy chain variable region ("HC") amino acid sequence |
| Ab 229 | 458 | EIVMTQSPSSLSASVGDRVTITCRASQSVSIYLNWYQQKGGKAPKLLIYGASALQRG VPSRFSGSGSGTDFTLTITSLQPEDFATYFCHQSYSAPQTFGQGTKVDIK | ADI-20976 | Light chain variable region ("LC") amino acid sequence |
| Ab 230 | 459 | EVQLVESGGGLVQPGGSLRLSCAASGFTFTNYAMSWVRQAPGKGLEWVSGISGS GGSTYYADSVKGRFTISRDNSKNTLYLQMNSLRAEDTAVYYCAKDQGYAVVVADA TRNLPPRYGMDVWGQGTTVTVSS | ADI-20977 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 230 | 460 | EIVLTQSPGTLSLSPGERATLSCRASHSVSSSYLAWYQQKPGQAPRLLIYGASSRATGI PDRFSGSGSGTDFTLTISRLEPEDFAVYYCQYGSSPPLTFGGGTKVDIK | ADI-20977 | Light chain variable region ("LC") amino acid sequence |
| Ab 231 | 461 | EVQLVESGAEVKKPGASVKVSCKASGYTFGNYGISWVRQAPGQGLEWMGWISAY NGNSNYAQKFQGRVTMTTDTSASTAYMEVRSLRSDDTAVYYCARDVPVTAARLLD YWGQGTLVTVSS | ADI-20978 | Heavy chain variable region ("HC") amino acid sequence |
| Ab 231 | 462 | DIVLTQTPLSLPVTLQQPASISCRSSQSLVYSDGNTYLSWFQQRPGQSPRRLIYKVSN RDSGVPDRFSGSGSGTDFTLKISRVEAEDVGVYYCMQATDWLGYTFGQGTKLEIK | ADI-20978 | Light chain variable region ("LC") amino acid sequence |
| Ab 232 | 463 | EVQLQESGPGLVKPSETLSLTCTVSGGSLRSYYWSWIRQPPGKGLEWIGNIYYGGST NYNSSLKGRVTISIDTSKNQFSLRLSSVTAADTAVYYCARDGLFPMGEWDYWGQGI LVTVSS | ADI-20979 | Heavy chain variable region ("HC") amino acid sequence |
| Ab 232 | 464 | QSALTQPASVSGSPGQSITISCTGTSNDVGDYNYVSWYQQHPGEAPKLMIYEVTNR PSGVSDRFSGSKSGNTASLTISGLQAEDEADYYCSSYTSTSTSVFGGGTQLTVL | ADI-20979 | Light chain variable region ("LC") amino acid sequence |
| Ab 233 | 465 | QVQLQESGPGLVKPSQTLSLTCSVSGGSVSSGDYYMTWIRQPAGKGLEWIGRIYNS GGTDYSPSLKSRVTISVDTSKNQFSLKLSSVTAADTAVYYCARGRGVYYESPWGQGTL VTVSS | ADI-20980 | Heavy chain variable region ("HC") amino acid sequence |
| Ab 233 | 466 | EIVLTQSPATLSLSPGERATLSCRASQSVGIYIGWYQQKPGQAPRLLIYGASNRATG IPDRFSGSGSGTDFSLTISSLEPEDFAVYYCQLRSKWLTFGPGTKVEIK | ADI-20980 | Light chain variable region ("LC") amino acid sequence |
| Ab 234 | 467 | QVQLQESGPRLVKPSETLSLICTVSGDSISRNYFMAWIRQPPGKGLEWIGTIYYSG NTYSNPSLKSRVTISVDTSKKQFSLNLSSVTAADTAVYYCARGAYGGDAFDIWGQG TVVTVSS | ADI-20981 | Heavy chain variable region ("HC") amino acid sequence |
| Ab 234 | 468 | DIRVTQSPSSVSASVGDRVTITCRASQGIGTWLAWYQQKPGKAPHLLIYAASRLQS GVPSRFSGSGSGTDFTLSISSLHPEDFATYYCQQAYAFPRTFGQGTKVEIK | ADI-20981 | Light chain variable region ("LC") amino acid sequence |
| Ab 235 | 469 | EVQLVESGPGLVKPSQTLSLLCCSVSGVSISRGSYYWSWIRQPAGGGLEWIGRIYTSG VTRYNPSLESRVTISLDSSQNQFFLRLSSVTAADTAVYYCATRESASYSSGPDAPDIW GQGTTVTVSS | ADI-20982 | Heavy chain variable region ("HC") amino acid sequence |
| Ab 235 | 470 | DIQMTQSPSTLSASVGDRVIITCRASQSVNSWLAWYQQKPGKAPKLLIYQASSLESG VPSRFSGSGSGTEFTLTINSLQPDDFATYYCQQYKTFSRPFGQGTKVEIK | ADI-20982 | Light chain variable region ("LC") amino acid sequence |
| Ab 236 | 471 | EVQLVESGGALVQPGGSLRLSCSASGFTFSSYAMHWVRQAPGKGLEYVSAINNFG DKTYYTDSVEGRFTISRDNSKKTLYLQMSSLRPEDTAVYYCVKDRGYCSSPSCYAVPY YFYGMDVWGQGTTVTVSS | ADI-20983 | Heavy chain variable region ("HC") amino acid sequence |
| Ab 236 | 472 | EIVMTQSPSSLSASVGDRVTITCQASQGISNYLHWYQQKPGKAPKLLIYDASNLEAG VPSRFSGSGAGTDFTFTISSLQPEDVATYYCQHYNNLPFTFGPGTKVDIK | ADI-20983 | Light chain variable region ("LC") amino acid sequence |
| Ab 237 | 473 | EVQLLETGAEVKKPGASVKVSCHVSGVGLTDLSMHVRQAPGKRLQMMGSFDP QYGETIDTQNFQGRVTMTVDTSTATLYMQLSGLRSEDTAMYYCATPQSTGALDN WGQGTLVTVSS | ADI-20984 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 237 | 474 | DIRVTQSPSSLSASVGDRVTITCRASQSISSYLSWYQQKPGKAPRLVIFAASNLQSGV PSRFSGTGSSRFSDSGSWTDFTLTISSLQPEDFAIYYCQQTYITPFTFGQGTKVDIK | ADI-20984 | Light chain variable region ("LC") amino acid sequence |
| Ab 238 | 475 | EVQLVESGGGLVQPGGSLRLSCVASGFTSNYWMNWVRQAPGKGLEWVANIKE DGSEIKYVDSVKGRFTISRDNAKNSLYLQMNSLRAEDTAVYYCARTEDSSSWFVAID YYNYMDVWGKGTTVTVSS | ADI-20986 | Heavy chain variable region ("HC") amino acid sequence |
| Ab 238 | 476 | DIQVTQSPGTLSLSPGERATLSCRASQTVSSSYLAWVQQKPGQAPPLLFYGASSRAT DIPDRFSASGSGTDFTLTIHRLEPEDFAVYYCQLYGRSPYTFGQGTKVEIK | ADI-20986 | Light chain variable region ("LC") amino acid sequence |
| Ab 239 | 477 | QVQLVQSGGGVVHPGRSLRLSCAASGFSFDYGMHWVRQAPGKGLEWVAVIWY DGINKYYADSVKGRFAISRDNSKNTLYLQMNSLRAGDTAVYYCARGGIAAAQRYFD YWGQGTLVTVSS | ADI-20987 | Heavy chain variable region ("HC") amino acid sequence |
| Ab 239 | 478 | ETTLIQSPGILSLSPGERATLSCRASQTVSSSNLAWYQQKPGQAPRLLIYGASSRAT GIPDRFSGSGSGTDFTLTISRLEPEDFAVYYCQQSGTSFGQGTKVDIK | ADI-20987 | Light chain variable region ("LC") amino acid sequence |
| Ab 240 | 479 | EVQLVESGGEVKKPGASVKVSCKTSGYPFSNYGISWMRLAPGQGLEWMGWISSY NGNTYYTKKFQGRVSMTTDTSTAVMELRSLRSDDTAVYYCARDVPVIAAHTFEY WGQGTLVTVSS | ADI-20988 | Heavy chain variable region ("HC") amino acid sequence |
| Ab 240 | 480 | ETTLTQSPLSLPVTLGQPASISCRSSESLVVSDGNTYLSWFQQRPGQSPRRIIYKVSNR DSGVPDRFSGSGSGTDFTLKISRVEAEDVGVYYCMQATHWPRDTFGQGTKVDIK | ADI-20988 | Light chain variable region ("LC") amino acid sequence |
| Ab 241 | 481 | EVQLLESGPGLVKPSGTLSLTCAVSGGSIINSNWWSWVRQSPGKGLEWIGDIYHSG STTYNPSLKSRVTISVDRSKNQYSLRLTSVTAADTAVYYCAKIGPDNRSGPDYYFM DVWGKGTTVTVSS | ADI-20989 | Heavy chain variable region ("HC") amino acid sequence |
| Ab 241 | 482 | BIVLTQSPSSLPASVGDRVTITCRASQSISNYVYWYQQKPGKAPKLLIYAASSLQSGV PSRFSGSGSGTDFTLSISSLQPEDFATYFCQQSYSTPPTFGQGTKLEIK | ADI-20989 | Light chain variable region ("LC") amino acid sequence |
| Ab 242 | 483 | EVQLVESGGGVVQPGRSLRLSCASASGFPFHSYAMHWVRQAPGKGLEWVAGIWYE GSSESYADSVKGRLIISRDNSRNTLYLQMNSLRVEDTAVYYCARRGSFSGFDSWGQ GSLVTVSS | ADI-20990 | Heavy chain variable region ("HC") amino acid sequence |
| Ab 242 | 484 | DIVMTQSPLSLPVTPGEPASISCRSSQSLLHSNGYNYLDWYLQKPGQSPQLLISLGSN RASGVPDRFSGSVAGTDFTLKISRVEAEDVGVYYCMQSSQTPYTFGQGTKVDIK | ADI-20990 | Light chain variable region ("LC") amino acid sequence |
| Ab 243 | 485 | EVQLVESGGNLVKPGGSLRLSCAASGFTFSGYVMSWIRQAPGKGLEWISDISGGSS YTNYADSVKGRFTISRDNAKNSLYLQMNSLRAEDTAMYYCARVEVDTTGPFHFDY WGQGTLVTVSS | ADI-20991 | Heavy chain variable region ("HC") amino acid sequence |
| Ab 243 | 486 | QPVLTQPPSVSGAPGQRVTISCTGSSNIGAGYDVHWYQQLPGTAPKLLIYGNNNR PSGVPDRLSGSKSGTSASLAITGLQAEDEADYYCQSYDSSLSGYVFGIGTKVTVL | ADI-20991 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 244 | 487 | EVQLVESGGGLVQPGGSLRLSCVVSGFTFKSYWMTWVRQAPGKGLEWVANIKED GSEKYYDSVKGRFTISRDNARNSLFLQMNSLRADDTAVYYCARNLEVSNEFYVVT DNYYLMDVWGQGTLVTVSS | ADI-20992 | Heavy chain variable region ("HC") amino acid sequence |
| Ab 244 | 488 | DIQLTQSPSSLSASVGDRVTITCRASQSISFFLNWYRQKPGKAPKLLIYAASTLQSGVP SRFSGSGSGTDFTLTISSLQPEDFASYYCQQSYSTPHTFGQGTKVEIK | ADI-20992 | Light chain variable region ("LC") amino acid sequence |
| Ab 245 | 489 | EVQLVESGGGVVQPGRSLRLICAASGFPFSSYAMHWVRQAPGKGLEWVATWY DGPNRDYADSVKGRFTVSRDNSKNTLYLQMTSLRADDTAVYYCARRGSWGSFDY WGQGTLVTVSS | ADI-20993 | Heavy chain variable region ("HC") amino acid sequence |
| Ab 245 | 490 | DIVMTQSPLSLSATPGEPASISCRPSQSLLHSNGYNYLEWYLQKPGQSPQLLIYLGSN RASGVPDRFSGGGSGTDFTLRISRVEADDVGVYYCMQASQTPYTFGQGTKVEIK | ADI-20993 | Light chain variable region ("LC") amino acid sequence |
| Ab 246 | 491 | QVQLVQSGAEVKKPGASVKVSCKASGYTFSSNVIGWVRQAPGQGLEWMGWIST NNGNTKYGQKFQGRVIMITDPSTSTAYMELRSLRSDDTAFYYCARESLGMGGFYF DYWGQGTLVTVSS | ADI-20994 | Heavy chain variable region ("HC") amino acid sequence |
| Ab 246 | 492 | QPVLTQPPSVSVAPGQTARITCGGDNIGSKSVHWYQKPGQAPVLVVYDDSDRPS GIPERFSGSNSGNTASLTISRVEAGDEADYCCQVWDSGSDLMVFGGGTKLTVL | ADI-20994 | Light chain variable region ("LC") amino acid sequence |
| Ab 247 | 493 | QVQLVESGPALVKPTQTLTLTCTFSGFSLTTRGMCVSWIRQPPGKALEWLARIDWD DDKYYSTSLKTRLTISKDTSKNQVVLTMTNMDPVDTATYYCARASTLTTAGYLHYK DVWGNGTTVTVSS | ADI-20996 | Heavy chain variable region ("HC") amino acid sequence |
| Ab 247 | 494 | DIRMTQSPSSLSASVGDRVTITCRASQSIGTYLNWFQQKPGKAPNLLIYAASILHSGV PSRFSGSGSGTDFTLTIRTLQPEDFATYYCQQSYPTVTFGQGTKVEIK | ADI-20996 | Light chain variable region ("LC") amino acid sequence |
| Ab 248 | 495 | EVQLVESGGGVVQPGRSLRLSCAASGFPFNSYGMHWVRQAPGKGLEWLAVIYFD ESTAYYADSVKGRFTISRDNSKSTLYLQMNSLRAADTAIYYCTTTVMIPYCGVFWG QGTLVTVSS | ADI-20997 | Heavy chain variable region ("HC") amino acid sequence |
| Ab 248 | 496 | EIVMTQSPGTLSLSPGDRATLSCRASQSVGSTHFAWYQQKPGQAPRLLIYAASIRAT GIPDRFSGGGSGTDFTLTISRLAPEDFAVYYCQQYGSTPITFGQGTRLEIK | ADI-20997 | Light chain variable region ("LC") amino acid sequence |
| Ab 249 | 497 | QVQLVQSGGGVVQPGRSLRLSCAASGFTLSTYGMHWVRQAPGKGLEWVAVIYYD ESNKFYADSVQGRFTISRDDSKNTLFLQMNSLRAEDTAVYYCARESRPRGYSYSDFD SWGQGTLVTVSS | ADI-20998 | Heavy chain variable region ("HC") amino acid sequence |
| Ab 249 | 498 | QPGLTQPRSVSGSPGQSVTISCTGTSSDVGTFNYVSWYQQHPGKAPKLMIYDVNQ RPSGVPDRFSGSKSGNTASLTISGLQAEDEADYCCAVAGYYSFGGGTKLTVL | ADI-20998 | Light chain variable region ("LC") amino acid sequence |
| Ab 250 | 499 | QVQLQESGPVLVKPSETLSLICTVSGGSITSSAAYMGWIRQPPGKGLEWIGSVSYSG TTSYTPSLKSRVTISGDASKEQFSLNLRSVTAADTAVYYCARQTKAFGRRDYGMDV WGQGTLVTVSS | ADI-20999 | Heavy chain variable region ("HC") amino acid sequence |
| Ab 250 | 500 | QPVLTQPPSVSAAPGQKVTISCSGSNSNIGSNFVSWYQQLPGTAPKLLIYENNKRPS GIPDRFSGSKSGPSATLGITGLQTEDEADYCGTWDTGLSAHWVFGGGTKLTVL | ADI-20999 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 251 | 501 | EVQLVESGPVLVKPRGTLTLTCTVSGFSLSDARMGVSWIRQPPGKALEWLAHIFWD DEKSYSTSLKNRLTISKDTSRGQVVLRMTNMDPVDTGTYFCARVNTYHSGGYYLYY FDVWGQGTLVTVSS | ADI-21000 | Heavy chain variable region ("HC") amino acid sequence |
| Ab 251 | 502 | EIVLTQSPSSLSASVGDRVTITCRASQIIASYLNWYQQKPGQAPKLLIYAASSLQSGVP SRFSGSGSGTDFTLTIISSLQPEDFATYYCQQSYSTRMYTFGQGTKVEIK | ADI-21000 | Light chain variable region ("LC") amino acid sequence |
| Ab 252 | 503 | EVQLVESGPGLVKPSETLSLTCTVSGGSISDIDYWNGWIRQPPGKGLEWIGSIYYSGS TYYNPSLESRVTISVDTSKNQFSLKLRSVSAADTALYHCARHGPPWVTAIRGHAFD VWGQGTTVTVSS | ADI-21001 | Heavy chain variable region ("HC") amino acid sequence |
| Ab 252 | 504 | DIRVTQSPDSLAVSLGERATINCKSSQSILYSSNNKNYLAWYQQKPGQPPKLLIYWA STRESGVPDRFSGSGSGTDFLTLTISSLQAEDVAVYYCQEYSYSPPMYTFGQGTKVDI K | ADI-21001 | Light chain variable region ("LC") amino acid sequence |
| Ab 253 | 505 | QVQLVESGPGLVKPSGTLSLTCAVSGDSINSGNWNWVRQAPGKGLEWIGEIYH RGTSNYNPSLKSRVTISVDQSKNQFSLKVTSLTAADTAIYYCARARGYSSGPSYYYL DVWGKGTLVTVSS | ADI-21002 | Heavy chain variable region ("HC") amino acid sequence |
| Ab 253 | 506 | EIVMTQSPSSLSASVGDRVTISCRASQSISTYLNWYQQKPGKAPKVIIYGASNLQSGV PSRFSGSGSGTDFTLTISSLQPEDFATYYCQKSFNPCVFGQGTKVDIK | ADI-21002 | Light chain variable region ("LC") amino acid sequence |
| Ab 254 | 507 | QVQLQQWGAGLLKPSETLSLLSCAVSGGSFSGYYWTWIRQPPGKGLEWIGEINHSG STNYNPSLKSRVTISVDTSKNQFSLKLSSVTAADTAVYYCARARYFDYLAHWSFDLW GRGTLVTVSS | ADI-21003 | Heavy chain variable region ("HC") amino acid sequence |
| Ab 254 | 508 | GIQMTQSPLSLPVTPGEPASISCRSSQSLLHSNGYKYLDWYLQKPGQSPQLLIYLGSD RASGVPDRFSGSGSGTDFTLKISRVEAEDVGYYCMQALQTPWTFGQGTKLEIK | ADI-21003 | Light chain variable region ("LC") amino acid sequence |
| Ab 255 | 509 | QVQLQESGGGVVQPGRSLTLSCAASGFTFSSYGMHWVRQAPGKGLDWVAEIWY DGSNKYVDSVKGRFTISRDNSKNTLYLQMKSLRAEDTAIYYCARDGGYESPFFDK WGQGTLVTVSS | ADI-21004 | Heavy chain variable region ("HC") amino acid sequence |
| Ab 255 | 510 | EIVMTQSPDSLGVSLGERATINCKSSQSLYTSNHENSLAWYQQKPGQPPRLLIYWA STRELGVPDRFSGSGSGTDFTLTISSLQAEDVAVYYCQQYHTTPLTFGPGTKVEIK | ADI-21004 | Light chain variable region ("LC") amino acid sequence |
| Ab 256 | 511 | EVQLVESGGAVVQPGGSLRLSCVASGLAFDEYTMHNVRQSSAKGLEWISLLSWNG GITYYADSVKGRFTISRDNSKNSLYLQMNSLRTEDTATYFCARLGYSGSGDYGDDY WGQGTLVTVSS | ADI-21005 | Heavy chain variable region ("HC") amino acid sequence |
| Ab 256 | 512 | ETTLTQSPGTLSLSPGERATLSCRASQSVSNNYLAWYQQKPGQAPRLLIHGASTRVT GIPARFSGSGSGTDFTLTISRLEPEDFAVYYCHQYHSSPRTFGQGTKVDIK | ADI-21005 | Light chain variable region ("LC") amino acid sequence |
| Ab 257 | 513 | QVTLKESGPTLVKPTQTLTLTCTFSGFSLSISGVGVGWIRQPPGKALEWLAVMWD DDKRYSPSLKIRLTIITKDTSKNQVVLTMTNMAPVDTAIYYCAHLWFGEAAFDPWG QGTLVTVSS | ADI-21006 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 257 | 514 | EIVLTQSPLSLPVTLRQTASISCRSGQSLLYSDGNTYLNWFQQRPGQSPRRLISIVSKR DSGVPDRFSGSGSGTDFTLKISRVEAEDVGVYCMQGTHWPYTFGGGTKVEIK | ADI-21006 | Light chain variable region ("LC") amino acid sequence |
| Ab 258 | 515 | QVQLVQSGADVKKPGASVKVSCKSSGYTFSNHSMHWVRQAPGQGLEWMGRIHP SSGTTTYAQKFQGRVTMTRDTSTSTVYMEVSSLRSEDTAVYYCARSPFFDFDFWG QGTMVTVSS | ADI-21007 | Heavy chain variable region ("HC") amino acid sequence |
| Ab 258 | 516 | SYVLTQPHSVSESPGKTVTISCTRSSGSIASNYVQWYQQRPGSAPTSVIYEDNQRPS GVPDRFSGSIDSTSNSASLTISGLKTEDEADYYCQSYYSSGWVFGGGTKLTVL | ADI-21007 | Light chain variable region ("LC") amino acid sequence |
| Ab 259 | 517 | QVQLQESGAGLLKPSETLSLTCTVYGGTFSGYHWNWIRQPPGKGLEWIGEINHRE NTDYNASLESRVTISVDTSKRQFSLKMNSVTVADTAVYYCARGIQVLTNLGTEVRVH QFLDLWGRGTLVTVSS | ADI-21008 | Heavy chain variable region ("HC") amino acid sequence |
| Ab 259 | 518 | DIVLTQTPATLSLSPGERATLSCRASQSVSTYLAWYQQKPGQAPRLLIYDASNRAAGI PARFSGSGSGTDFTLTISSLEPEDFAVYYCQQRTNWLPLTFGGGTKVDIK | ADI-21008 | Light chain variable region ("LC") amino acid sequence |
| Ab 260 | 519 | QVQLVQSGAEMKTPGASVKVSCKASGYSFSNYGFTWVRQAPGQGLEWMGWIS GYSAKTNYAQDLQGRVTMTIDTSTSTSYMELRSLRSDDTAVYYCARDPLGYFGSGT YRGGAPDFWGQGTTVTVSS | ADI-21009 | Heavy chain variable region ("HC") amino acid sequence |
| Ab 260 | 520 | QSALTQPASVSGSPGQSITLSCTGTNNDVGSYHLVSWYQQYPGKAPKLVIYEVTKR PSGVSNRFSGSKSGNTASLTISGLQPEDEADYYCCSSAGDRRIFGGGTKVVL | ADI-21009 | Light chain variable region ("LC") amino acid sequence |
| Ab 261 | 521 | EVQLVESGGGVVQPGRSLRLSCAASGFSFSTYGMHWVRQAPGKGLEWVGVIWY DETTKYYADSVKGRFSISRDNSKNMVYVQMNSLRADDTALYYCAREVWGGVFDI WGQGTTVTVSS | ADI-21010 | Heavy chain variable region ("HC") amino acid sequence |
| Ab 261 | 522 | DIQMTQSPATLSASVGDRVTITCRASQNIVTWLAWYQQKPGKAPNLLIYKASSLES GVPSRFSGSGSGTEFTLTISSLQPDDFATYYCQHYNSYSGAFPGQGTKVDIK | ADI-21010 | Light chain variable region ("LC") amino acid sequence |
| Ab 262 | 523 | QVQLQESGPGLVKPSETLSLSCTASGDSIDYYWSWIRQPPGKGLEWIGFVSDTWG TNYSPSLTSRVAISLDTSRSQVSLRLRSVTAADTAVYYCVRTHLYDRGGYYLYFPDYW GQGTLVTVSS | ADI-21011 | Heavy chain variable region ("HC") amino acid sequence |
| Ab 262 | 524 | DIRMTQSPPSLSASVGDRVTITCRASQRIASYLNWYQQKPDTAPKLLIYAASNLQTG VPSRFSGSGSGTDFTLTISSLQPEDFATYYCQQSYSTPYTFGQGTKLEIK | ADI-21011 | Light chain variable region ("LC") amino acid sequence |
| Ab 263 | 525 | QVQLVQSGPAVVKPTQTLTLTCSFSGFSLSTSRMSVSWIRQPPGKALEWLARIDWD GDKYYSTSLKSRLTISKDTSKNQVVLTMTNMDPVDTATYYCARGSYVSSGYYLNYF DYWGQGTLVTVSS | ADI-21012 | Heavy chain variable region ("HC") amino acid sequence |
| Ab 263 | 526 | DIRMTQSPSSLSASVGDRVTITCRTSQTIASYLNWYQQKPGKAPNLLIYAASILQTGV PSRFSGSGSGTDFTLTISSLQPEDFATYYCQQSYGTPQTFGQGTKVEIK | ADI-21012 | Light chain variable region ("LC") amino acid sequence |
| Ab 264 | 527 | QVQLQESGPGVVKPSETLSLTCTVSGGSISNTHSYWGWIRQSPGKGLEWIGSIYYT GSTYYNPSFRSRVTLSVDTSKNQFSLKLSSVTAADTAVYYCAAPDYFVLIDYKSTFDY WGRGALVTVSS | ADI-21013 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 264 | 528 | DIVMTQSPGTLSLSPGGRATLSCRASQSVGSSSLAWYQQKPGQAPRLLIYGASSRA AGIPDRFSGSGSGTDFTLTINRLEPEDFAMYYCQQYGSSPLTFGGGTKVEIK | ADI-21013 | Light chain variable region ("LC") amino acid sequence |
| Ab 265 | 529 | QVQLQESGPGLVKPSETLSLICTVSGGSISNYYWSWIRQPPGKGLEWIGYVWFGTT KYNPSLKNRVTISVDTGKNQVSLKVNSVTAADTAIYYCARDSSIWRGAFEIWGQG TTVTVSS | ADI-21014 | Heavy chain variable region ("HC") amino acid sequence |
| Ab 265 | 530 | DIRLTQSPSSLSASVGDRVTITCQASQDISNHLNWYQQRPGKAPELLIYDASTLETG GPSRFSGSGSGTDFTLTISSLQPEDFADYYCQQYDNLPVTFGGGTKVDIK | ADI-21014 | Light chain variable region ("LC") amino acid sequence |
| Ab 266 | 531 | QVQLVQSGAEVKKPGASVRVSCKVPGNTLSDLSMHVRHTPGEGLEWMGSFDP EYGETIPAQRFQGRVTMTEDTSTDTAYMELTSLRFEDTAVYYCAAPHASGALQHW GQGTLVTVSS | ADI-21015 | Heavy chain variable region ("HC") amino acid sequence |
| Ab 266 | 532 | DIVMTQSPSSLSASVGDRVTITCRASQIISAYLNWYQQKAGKAPKLLIYAASSLQSGV PSRFSGSGSGTDFTLTISSLQPEDFATYYCQQTYIITPFTFGQGTKLEIK | ADI-21015 | Light chain variable region ("LC") amino acid sequence |
| Ab 267 | 533 | QVQLVESGTEVKKPGASVKVSCKASGYTFTNYGITWVRQAPGQGLEWMGCISGY NGNTNYAQNLQGRVTMTTDTSTNTAYMELRSLISDDTAVYYCARDTGLTAAALLD YWGQGTLVTVSS | ADI-21017 | Heavy chain variable region ("HC") amino acid sequence |
| Ab 267 | 534 | DIVLTQSPLSLPVTLGQPASISCRSSQSLVVSDGNTYLSWFQQRPGQSPRRLIYKVSN RDSGVPDRFGGSGSGTYFTLKISRVEAEDVGIYYCMQAIHWPLTFGGGTKVEIK | ADI-21017 | Light chain variable region ("LC") amino acid sequence |
| Ab 268 | 535 | EVQLLESGGGLVKPGGSLRLSCAGSGFTLSSYGMNWVRQAPGQGLEWISSISSSSS YINYADSVKGRFTISRDNAQNSLYLQLNSLRAEDTAVYYCARGGLGYDYGLGSYTYA DYWGQGTLVTVSS | ADI-21018 | Heavy chain variable region ("HC") amino acid sequence |
| Ab 268 | 536 | QSVVTQPPSVSGAPGQRVTISCTGSSSNTGAGYDIHWYQQLPGTGPKLLIYGNKNR PSGVPDRFSGSKSGTSASLAITGLQAEDEADYYCQSYDSSLSGWVFGGGTKVTVL | ADI-21018 | Light chain variable region ("LC") amino acid sequence |
| Ab 269 | 537 | EVQLLESGGGLVRPGGSLRLSCAVSGFTFSGNALTWIRRAPGKGLEWVSTIGDSGG GSYYADSVKGRFTISRDNSKSTLYLQMNSLTAEDTAVYYCARDPYGDYRDYYGIDV WGQGTTVTVSS | ADI-21019 | Heavy chain variable region ("HC") amino acid sequence |
| Ab 269 | 538 | EIVMTQSPLSLPVTPGEPASISCRSSQSLRHSNGYNYVDWYLQKPGQSPQLLIYLGS NRASGVPDRFRGSGSGTDFTLKISRVEAEDVGVYYCMQALQTPLIFGQGTKVEIK | ADI-21019 | Light chain variable region ("LC") amino acid sequence |
| Ab 270 | 539 | QVQLQQWGAGLLKPSETLSLTCAVHGGSFSGFYWSWIRQSPGKGLEWIAEINDSG NTNHNPSLKSRVTISIDTSKNQFSLNVSSVTAADTAVYYCAKNGGHHYVGTLRFRS RAFDIWGQGTMVTVSS | ADI-21021 | Heavy chain variable region ("HC") amino acid sequence |
| Ab 270 | 540 | EIVMTQSPSTLSASVGDRVTITCRASQSIGNRLAWYQQKPGKAPKLLISLASGLETGV PSRFSGSGSGTEFTLTITSLQPDDFATYYCQQYSSYGTFGQGTKLEIK | ADI-21021 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 271 | 541 | EVQLVETGPGLVKPSETLSLTCSVSGGSISSYYWSWIRQPPGKGLEWIGYIYNSGRT NYNPSLRSRVTISVDTSQNQFSLRLGSVTAADTAVYYCARGAGDDLLRGSYRYLNF WGQGTLVTVSS | ADI-21022 | Heavy chain variable region ("HC") amino acid sequence |
| Ab 271 | 542 | QSVLTQPPSVSVAPGQTARITCGGNNIGSKSVHWYQQKPGQAPVLVVYDDTERPS GIPERISGSNSGNTATLTISRVEAGDEADYYCQVWDSSSDHPDLLFGGGTKLTVL | ADI-21022 | Light chain variable region ("LC") amino acid sequence |
| Ab 272 | 543 | EVQLVESGGGLVKPGGSLRLSCAASGFRFSSYGMHWVRQAPGRGLEWVSSITAGS SYMDYADSVKGRFSISRDNAKTSLYLQMNSLRAEDTAIYYCARENYDTGRGLNWF DPWGQGTLVTVSS | ADI-21023 | Heavy chain variable region ("HC") amino acid sequence |
| Ab 272 | 544 | QSVTQPPSVSGAPGQRVTISCTGSSSNIGAGYDVHWYRQLPGTAPEVLIYGNNN RPSGVPDRFSGSKTGTSASLAITGLLAEDGADYYCQSYDRSQLWVPGGGTQLTVP | ADI-21023 | Light chain variable region ("LC") amino acid sequence |
| Ab 273 | 545 | EVQLVESGGGLVRPGGSLRLSCEASGLKLSGYSMNWVRQAPCKGLEWVSSISASSS YIHYADSLKGRFTISRDNAKNSLYLQMNSLRAEDTAVYYCVASWLTPGWFDPWGQ GTLVTVSS | ADI-21025 | Heavy chain variable region ("HC") amino acid sequence |
| Ab 273 | 546 | QPVLTQPPSVSGAPGQTVTISCTGSSSNIGAGYDVHWYQQLPGTAPKLLIYGNTNR PSGVPDRFSGSKSGTSASLAVTGLQAEDEGDYYCQSYDSSLSGSAFPGGGTKLTVL | ADI-21025 | Light chain variable region ("LC") amino acid sequence |
| Ab 274 | 547 | QVQLVQSGPGLVKPSQTLSLTCTVSGGSISSGGFYMSWIRQHPGKGLEWIGHIYYS RSTYYNPSLKSRVTMSLNMSKNQFSLRLSSVTAADTAVYYCARERREWLHGELDY WGQGTLVTVSS | ADI-21026 | Heavy chain variable region ("HC") amino acid sequence |
| Ab 274 | 548 | DIQMTQSPDSLAVSLGEGATINCKSSQSVLDSSKNNYLAWYQQRPGQPPKLLISW ASTRESGVPDRFSGSGSGTDFTLTISSLQAEDVAVYCCQQYFSPPATFGQGTKLEIK | ADI-21026 | Light chain variable region ("LC") amino acid sequence |
| Ab 275 | 549 | QVQLQESGPGLVKPSGTLSLTCVVSGGSIRSHNYWTWVRQPPGKGLEWIGEIYHS GNTNYNPSLKSRVTLSIDKSKNVFSLRLNSVTAADTAVYYCVGGGPFAPYFENWG QGTLVTVSS | ADI-21027 | Heavy chain variable region ("HC") amino acid sequence |
| Ab 275 | 550 | QSVLTQPPSVSGAPGQRVTISCTGSSSNIGAGYAVHWYHQLPGTAPKLLIYDNNNR PSGVPDRFSGSKSGSSASLAITGLQAEDEADYYCQSYDRSLSGYVPGTGTKLTVL | ADI-21027 | Light chain variable region ("LC") amino acid sequence |
| Ab 276 | 551 | EVQLVESGGALVKPGGSLRLSCVASGFTFSDYYMHWVRQAPGKGLEWVSYISSTSS FTNYADSVKGRFIISRDNAKNSLYLQLNSLRAEDTAVYYCARDESSGWQTRRHFGM DVWGQGTLVTVSS | ADI-21028 | Heavy chain variable region ("HC") amino acid sequence |
| Ab 276 | 552 | EIVMTQSPSTLSASVGDRVTITCRASQSLNTWLAWYQHKPGKAPKLLISTASSLQSG VPSRFSASGSGTEFTLTISSLQPDDFATYYCCQQFRGTFGPGTKVEIK | ADI-21028 | Light chain variable region ("LC") amino acid sequence |
| Ab 277 | 553 | QVQLVQSGAEVRKPGESLKISCKASGYSFTNYWIGWVRQMPGKGLEWMGIVYPA DSHPVYSPSFQQQVTFSTDKSINTAYLQWSSLKASDTAMYFCARRDGGTDYLSDAF DIWGQGTMVTVSS | ADI-21029 | Heavy chain variable region ("HC") amino acid sequence |
| Ab 277 | 554 | DIVMTQSPSSLSASVGDRVTITCRTSQSIRRYLNWYQQKPGKAPKLLIYAASSLQSGV PSRFSGSGSGTDFTLTISSLQPEDFATYYCQQSYSTNTFGGGTKVEIK | ADI-21029 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 278 | 555 | EVQLVESGGGLVKPGGSLRLSCAASGFKFSTYYMSWIRQAPGKGLEWVSNISGGSSYSNHADSVKGRFTISRDNAKNSLYLEMNSLRAEDTAVYYCAREDLMGVSGLAYFEYWGQGILVTVSS | ADI-21030 | Heavy chain variable region ("HC") amino acid sequence |
| Ab 278 | 556 | QPVLTQPPSVSGAPGQRVTISCTGRSSNIGAGYDVNWYKQLPGAVPKVLIYGNTNRPSGVPDRFSGSKSGNSASLAITGLQAEDEADYYCQSYDRNLGYVFGTGTKLTVL | ADI-21030 | Light chain variable region ("LC") amino acid sequence |
| Ab 279 | 557 | EVQLVESGPGLVKPSQTLSLTCTVSGGSISNSNYFWSWIRQPAGKGLEWIGRVHSSGTTSYNPSLKSRITISVDASESQFSLNLTSVTAADTAIYYCARDSSDWGLGWYFDLWGRGTLVTVSS | ADI-21031 | Heavy chain variable region ("HC") amino acid sequence |
| Ab 279 | 558 | ETTLTQSPATLSLSPGERATLSCRASQSVTFYLAWYQHKPGQAPRLLIFDASKRATGIPARFSGSGSGTDFTLTISSLEPEDFALYYCQQRSDWPQTFGQGTKVDIK | ADI-21031 | Light chain variable region ("LC") amino acid sequence |
| Ab 280 | 559 | EVQLVESGGGLVKPGGSLRLSCAVSGFKFSSYTMNWVRQAPGKGLEWVSSVSASSSYIFYADSVQGRFIISRDNAQNSLYLQMNSLRADDTAVYYCTRDQYGPGHYYNPAWFDPWGQGTLVTVSS | ADI-21032 | Heavy chain variable region ("HC") amino acid sequence |
| Ab 280 | 560 | QPVLTQPPSASGAPGQRVTISCTGSSSNIGAGYDVHWYQQLPGTAPKVLIYGNTNRPSGIPDRFSGSKSGTSASLAIIGLQAEDEADYYCQSYDRNGSKVFGTGTKLTVL | ADI-21032 | Light chain variable region ("LC") amino acid sequence |
| Ab 281 | 561 | QVQLVQSGAEVRKPGDSLKICKFSENIFTTYYWTGWVRQMPGRGLEWMGIIFPGDSDTRYSPSFQGHVTISVDKSIATAFLQWSLKASDSAMYYCARAKYEGSFDMWGQGTMVTVSS | ADI-21033 | Heavy chain variable region ("HC") amino acid sequence |
| Ab 281 | 562 | DIQVTQSPSSLSASVGDRVSITCQASQDIRNRLNWYQQKPGKAPKLLIYDASILETGVPSRFSGSGSGTDFTFSISSLQPEDFATYYCQQYDSFLFTFGPGTKVEIK | ADI-21033 | Light chain variable region ("LC") amino acid sequence |
| Ab 282 | 563 | QVQLQQSGAEVKKPGESLTISCKGSGYSFGNYWISWVRQMPGKGLEWMGRIDPSDSYVNYSPSFQGNVTMSVDKSSSTAYLQWSSLKASDTAMYYCARLAGYSTLWGQGTLVTVSS | ADI-21034 | Heavy chain variable region ("HC") amino acid sequence |
| Ab 282 | 564 | EIVLTQSPGTLSLSPGERATLSCRASQSFGSIYLAWYQQKPGQAPRLLIYGTSSRATGIPDRFSGSGSGTDFTLTIRRLEPEDFAVYYCLYYGSSPGATFGPGTKVDIK | ADI-21034 | Light chain variable region ("LC") amino acid sequence |
| Ab 283 | 565 | EVQLVESGHEVKKPGASVKVSCKASGYTFPSYGISWVRQAPGQGLEWMGWIVPYNGNTKYAQRFQGRITMTTDSPTSTASMELRGLRSDDTAVYYCARVRGDGYSYGYEYWGQGTLVTVSS | ADI-21035 | Heavy chain variable region ("HC") amino acid sequence |
| Ab 283 | 566 | DIVLTQSPSTLSASVGDRVTITCRASQSISIWLAWYQQKPGKAPKLLIYKTSELVSGVPSRFSGSGSGTEFTLTISGLQPDDFATYYCQQQNSYSHTFGQQTKVEIK | ADI-21035 | Light chain variable region ("LC") amino acid sequence |
| Ab 284 | 567 | QVQLVQSGAEVKEPGKSLKISCKGSGNHFGNVWIAWVRQMPGKGLEWMGIIYPGDSDTRYSPSFQDVTISVDKSINTVYLQWSSLKAADTATYYCAGSKLGNSWYTIYDSWGQGTLVTVSS | ADI-21036 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 284 | 568 | NFMLTQPASVSGSPGQSITISCAGPSALIGYNLVSWYQQVPGKAPKLIIYEGSKRPS GVSHRFGSKSYTASLTISGLQTEDEADYYCCSYAGSGTSVVFGGGTKVTVL | ADI-21036 | Light chain variable region ("LC") amino acid sequence |
| Ab 285 | 569 | QVQLVQSGGGVVQPGRSLRLSCAASGFPFSSYAMHWVRQAPGKGLEWVAVIWY PGGEKYSADSVTGRFTISRDNSKNTLYLQMSSLRVEDTAVYYCARRSVGAPDYWGQ GTLVTVSS | ADI-21037 | Heavy chain variable region ("HC") amino acid sequence |
| Ab 285 | 570 | DIQMTQSPLSLPVTPGEPASISCRSSQSLLNSNGYNYLDWYLQKPGQSPQVLIYLGS HRASGVPDRFSGSGSGTDFTLRISRVEAEDVGVYYCMQAVQTPYTFGQGTKVEIK | ADI-21037 | Light chain variable region ("LC") amino acid sequence |
| Ab 286 | 571 | QVQLVQSGAEVKKPGESLKISCQGFGFSFTSYWIGWVRQTPGKGLEWMGTIYPGD SETRKSPSIQQQVTFSADRSISTAYLQWSGLTASDTAVYYCARLKGGWGTTMAGIR DYFYYGLDVWGQGTTVTVSS | ADI-21038 | Heavy chain variable region ("HC") amino acid sequence |
| Ab 286 | 572 | EIVLTQSPGTLSLSPGERATLSCRASQSVSSSYLAWVQQKPGQAPRLLIYGASSRATG IPDRFTGSGSGTDFTLTISRLEPEDFAVYYCQQYATSLGGFTGPGTKVDIK | ADI-21038 | Light chain variable region ("LC") amino acid sequence |
| Ab 287 | 573 | EVQLVQSGAEVKKPGASVKVSCKASGYTFISYYIHWVRQAPGQGLEWMGVINPSG GITDYAPKFQGRVSMTRDTSTRTVYLELSSLRSDDTAVYYCARDLCITTSCPRYYDYA WRSYRSEGYFDSWGQGTLVTVSS | ADI-21039 | Heavy chain variable region ("HC") amino acid sequence |
| Ab 287 | 574 | EIVMTQSPLSLPVTPGEPASISCRSSQSLLHSNGYNYLDWYLQKPGQSPQLLIYLGSN RASGVPDRFSGSGSGTDFTLKISRVEAEDVGVYYCMQAQQAPFTFGGGTKVEIK | ADI-21039 | Light chain variable region ("LC") amino acid sequence |
| Ab 288 | 575 | EVQLLESGPGLVKPSGTPSLTCAVSGVSITNSNNWMTWRQPPGKGLEWIGEIYSS GSTNYSPSLKSRVTIISLDKSKNQFSLKLSSVTAADTAVYYCARVLGYYGSGGGHLHS WGPGTLVTVSS | ADI-21040 | Heavy chain variable region ("HC") amino acid sequence |
| Ab 288 | 576 | SYELTQPPSASGTPGQRVTISCSGSSSNIGAGYDVHWYQQLPGTAPKLLISVNSNRP SGVPDRFSGSKSGTSASLAITGLQAEDEANYYCQSYDNSLSGYVVFGGGTKLTVL | ADI-21040 | Light chain variable region ("LC") amino acid sequence |
| Ab 289 | 577 | EVQLVESGGVVVQPGGSLRLSCAASGFTFDDYTMHWVRQAPGKGLEWVSLISWV GDTTYYADSVKGRFTISRDNSKNSLYLQMNSLRTEDTALYYCAKGGYYDGSGYYFD YWGQGTLVTVSS | ADI-21041 | Heavy chain variable region ("HC") amino acid sequence |
| Ab 289 | 578 | DIRLTQSPSSLSASVGDRVTITCRASQSISNYLNWYQQKPGKAPKLLMYAASSLQSG VPSRFSGSGSGTDFTLTISSLQPEDFATYSCQQSYSTPYTFGQGTKVEIK | ADI-21041 | Light chain variable region ("LC") amino acid sequence |
| Ab 290 | 579 | EVQLVESGPRLVKPSQTLSLTCNVSGVPVNTGGYYWSWIRRHPIKGLEWIGYIYYSG STHYNPSLRGRATMSVDTSKNQFSLRLSSVTAADTAVYYCAKDTITVLRGVAKKGVF DPWGQGILVTVSS | ADI-21042 | Heavy chain variable region ("HC") amino acid sequence |
| Ab 290 | 580 | DIQMTQSPSTLSASVGDRVIITCRASQSISWLAWYQYKPGKAPNLLIYKATTLDSG VPSRFSGSGSGTEFTLTISSLQPDDFATYYCQQYDSYPTFGQGTKVEIK | ADI-21042 | Light chain variable region ("LC") amino acid sequence |
| Ab 291 | 581 | QVQLVQSGAEVKKPGASVKVSCKASGYTFTSYGITWVRQAPGQGLEWMGWISTY NGKTNYAQKFKGRVTMTTDTSTSTAYVELTSLRSDDTAVYYCAREFPTRIVDSFYM DVWGKGTTVTVSS | ADI-21043 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 291 | 582 | SYELTQPPSVSVAPGQTARITCGGSNIGSETVHWYQQKPGQAPVLVVYGDSDRPS GIPERFSGSNSGNTATLTISRVEAGDEADYYCQVWDSRSDDFHVFGSGTKLTVL | ADI-21043 | Light chain variable region ("LC") amino acid sequence |
| Ab 292 | 583 | QVQLVQSGAELKKPGESLKISCKTSGYTFANYWIGWVRQMPGKGLEWMGIIYPGD SDTRYSPSFQGQVTFSADKSINSAYLQWHSLKASDSAIYYCARRFSPDYSDGAAPPT LSDAFDVWGQGTTVTVSS | ADI-21044 | Heavy chain variable region ("HC") amino acid sequence |
| Ab 292 | 584 | DIVMTQSPSSLSASVGDRVITTCRASQNINIYLNWYQQKPGKAPKLLIYAASTLQSG VPSRFSGSGSATDFTLTISSLQPEDFATYYCQQSYRTPNDPFGRGTKVDIK | ADI-21045 | Light chain variable region ("LC") amino acid sequence |
| Ab 293 | 585 | EVQLVESGGGLVKPGGSLRLSCLASGFKFRSYSMNWVRQAPGTGLVWVASISASSS FIFYADSLKGRPTISRDNDKNSLYLQMNSLTVEDTAVYYCVRDMSGISSGGKTFDYW GQGTLVTVSS | ADI-21045 | Heavy chain variable region ("HC") amino acid sequence |
| Ab 293 | 586 | QSVLTQPPSVSGAPGQRVTISCTGSSSNLGAGYDVQWYQQLPGTAPKLLIYGNNN RPSGVPDRFSGSKSGTSASLAITGLRAEDEADYYCQSYDTSPVFGGGTKLTVL | ADI-21046 | Light chain variable region ("LC") amino acid sequence |
| Ab 294 | 587 | EVQLVESGAEAKKPGESLRISCTVSGYSFSKYWVGWVRQTPGKGLEWMGIIDPTDS DTRYSPSFQGQVTISVDNSINTAYLQWSSLKASDTAIYYCARRGQAKCVGNCPRDF MDVWGKGTTVTVSS | ADI-21046 | Heavy chain variable region ("HC") amino acid sequence |
| Ab 294 | 588 | SYVLTQPPSVSGAPGQRVTISCAGSSSNIGAGYEVHWYQQLPGTAPKLLIYANRNR PSGVPDRFSGSRSGTSASLAISGLQAEDEADYYCQSYDNNLSGSWVFGGGTKLTVL | ADI-21047 | Light chain variable region ("LC") amino acid sequence |
| Ab 295 | 589 | QVQLQQWGAGLLKPSETLSLTCAVYGGSFSGKYWSWIRQPPGKGLEWIGENHD GTTYYNPSLKSRVTISADTPKNQFSLTLHSVTAADTAVYYCARLTILSDWGQGTLVTV SS | ADI-21047 | Heavy chain variable region ("HC") amino acid sequence |
| Ab 295 | 590 | DIRMTQSPSSLSASVGDRVTITCQASQDISNYLHWYQQKPGKAPKLLIYDASNLETG VPSRFSGSGSGTDFTFTIHSLQPEDLATYYCQQYDLPRTFGQGTKLEIK | ADI-21048 | Light chain variable region ("LC") amino acid sequence |
| Ab 296 | 591 | EVQLVESGAEVKKPGASVKVSCKASGYTFSSHAISWVRQAPGHGLEWMGWISVF NGNTNYAQKFQGRVTMTTDTSTSTAYMELRSLRSDDAAVYYCAREVIGVGEFYFD YWGQGTLVTVSS | ADI-21048 | Heavy chain variable region ("HC") amino acid sequence |
| Ab 296 | 592 | QSVLTQPPSVSVAPGQTARITCGGNNIGSKSVHWYQQKAGQAPVLVVYDDSDRPS GIPERFLGSNSGNTATLTISRVEAGDEADYYCQVWDSSGDFHVFGTGTKVTVL | ADI-21049 | Light chain variable region ("LC") amino acid sequence |
| Ab 297 | 593 | EVQLVESGGGLVKPGGSLRLSCSASGFAFSSYSMNWVRQAPGKGLEWVSSISASSS YIFYADSVKGRFTISRDNAKNSLYLQMNSLRAEDTAFYYCARALSPGYGDYRDYWG QGTLVTVSS | ADI-21049 | Heavy chain variable region ("HC") amino acid sequence |
| Ab 297 | 594 | QSVVTQPPSVSGAPGQRVTISCTGSSSNIGAGYDVHWYQQLPGAAPKLLIYGNNN RPSGVPDRFSGSKSGTSASLAITGLQAEDEADFYCQSYDHNLSVVFGGGTKLTVL | ADI-21049 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 298 | 595 | QVQLVQSGAEVKKPGASVKVSCTASGYTFANNGISWVRQAPGQGLEWMGWISAYNGNTKYAQTVQGRVILTIDTSTSTAYMELRSLTSDDTAVYYCAREMGVDAAATFDYWGQGTLVTVSS | ADI-21050 | Heavy chain variable region ("HC") amino acid sequence |
| Ab 298 | 596 | EIVMTQSPLFLSVTLGQPASISCRSSQSLVSDTNTYLTWFQQRPGQSPRRLIYKVSNRDSGVPDRFSGSGSGTYFTLKISRVEAEDIGVYYCMQAIHWPRTFGQGTKLEIK | ADI-21050 | Light chain variable region ("LC") amino acid sequence |
| Ab 299 | 597 | QVQLVESGPGLVRPSQTLSLTCNVSGDFISRGTYWSWIRQSAGKGLEWICRIYTSGITDYSPSLKSRVTISVDTSKNQFFLKLASVTAADTAVYYCARGRGYYDSPWGQGTLVTVSS | ADI-21051 | Heavy chain variable region ("HC") amino acid sequence |
| Ab 299 | 598 | ETTLTQSPATLSLSPGERATLSCRASESVSTFLGWYQQKPGQAPRLLIYDASNRASGVPARFSGSGSGTDFTLTISSLEPEDFAVYYCQLRNKWLITFGPGTKVDIK | ADI-21051 | Light chain variable region ("LC") amino acid sequence |
| Ab 300 | 599 | QVQLVQSGAEVKKPGASVKVSCKASGYTFTSYGISWVRQAPCQGLEWMGWISAYNGNTNYAQNLQGRVTMTTDTSTSTAYMELRSLRSDDTAMYCARDAFSRVGYWYFDLWGRGTLVTVSS | ADI-21052 | Heavy chain variable region ("HC") amino acid sequence |
| Ab 300 | 600 | SYELTQPPSVSVAPGQAARITCGGNNIGSKTVHWYQQKPSQAPVLVVYDDSDRPSGIPERFSGSNSGNTATLTISRVEAGDEADYYCQVWDSSGDHPVFGGGTKLTVL | ADI-21052 | Light chain variable region ("LC") amino acid sequence |
| Ab 301 | 601 | QVQLQESGPGLVKPSQTLSLTCTVSGVSISNSSGGYYWSWIRQHPGKGLEWIGYIYYSGSTYYNPSSGSTYYNPSLKSRVTVSVDTSKNQFSLKLTSVTAADTAVYYCARDIRGPHKHSLINWFHPWGQGTLVTVSS | ADI-21053 | Heavy chain variable region ("HC") amino acid sequence |
| Ab 301 | 602 | DIQMTQSPSSLSASVGDRVTITCRASQSISSYLNWYQQKPGKAPKLLIYAASSLQTGVPSRFSGSGSGTDFTLTISSLQPEDFATYYCQQSYSTLRTFGQGTKVDIK | ADI-21053 | Light chain variable region ("LC") amino acid sequence |
| Ab 302 | 603 | QVQLVESGGGVVQPGRSLRLSCAASGFSFSNYGMHWVRQAPGKGLEWVVGISFDGSYIFHGGSVTGRFNISRDNSKNTLYLQVNSVRAEDTAVYYCARDPQYYDDWSGYSGLLHYYLYMDVWGKGTTVTVSS | ADI-21054 | Heavy chain variable region ("HC") amino acid sequence |
| Ab 302 | 604 | DIQLTQSPSTLSASVGDRVTITCRASQSIGTSLAWYQQIPGKAPKLLIYRASSLESGVPSRFSGSGSGTQPTLTIISSLQPDDFATYYCQQYNNYSPTFGQCTKLEIK | ADI-21054 | Light chain variable region ("LC") amino acid sequence |
| Ab 303 | 605 | EVQLVESGGGVVQPGRSLRLSCVGSGFTFSRYGMQNWVRQAPGKGLEWAAVIWNDGSNEHYADSVKGRFTISRDNSKNTMYLQMNSLRAEDTALYYCAREGEYSSSWSHWSYLDLWGRGTLVTVSS | ADI-21055 | Heavy chain variable region ("HC") amino acid sequence |
| Ab 303 | 606 | QPGLTQPPSASGTPGQRVTISCSGSTSNIGGNTVNWYQQLPGTAPTVLIYQNRQRPSGVPDRFSGSKSGTSASLAISGLQSDDEADYYCAAMDDSLNGWVFGGGTKLTVL | ADI-21055 | Light chain variable region ("LC") amino acid sequence |
| Ab 304 | 607 | EVQLLESGGGLVKPGGSLKLSCAASGFTLRSYYMHWVRQAPGRGLEWVSSISASSSYINYVDAVKGRFTVSRDNAKNSLFLQMNSLRAEDTAVYYCAREGGAMTNFGVVIDIWGQGTMVTVSS | ADI-21056 | Heavy chain variable region ("HC") amino acid sequence |
| Ab 304 | 608 | SYVLTQPPSVSGAPGQRVTISCTGSSSNIGAGYDVHWYQQLPGTAPKLLIYTNTNRPSGVPDRFSGSKSGTSASLAITGLQSDDEADYYCQSYDSSLSGPVVFGGGTKLTVL | ADI-21056 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 305 | 609 | QVQLVQSGAEVKKPGESLKISCKASGYSLSNNWIAWVRQMPGKGLEWMGIVYLG DSDARYSPSFGQVTFSADKSISTAYLQWSSLQASDTAMYFCARHHGDLVTSDSR YFYGLDVWGQGTTVTVSS | ADI-21057 | Heavy chain variable region ("HC") amino acid sequence |
| Ab 305 | 610 | DIVMTQSPATLSVSPGERATLSCRASQSISSNLAWYQQKPGQAPRLLIYGASTRATG IPARFSGSGSGTEFTLTISSLQSEDFAVYYCQQYNNWPPSDTFGQGTRLEIK | ADI-21057 | Light chain variable region ("LC") amino acid sequence |
| Ab 306 | 611 | QVQLQESGPGLVKPSETLSLITCTVSGGSISGTTYYMAWIRQPPGKGLEWIGTIFYSG STYYNPSLQSRVTTSVDASKNQMSLRLSSVTAADTAMYYCARHTSIYDNLTGFYSHL TGVLDMWGQGTMVTVSS | ADI-21058 | Heavy chain variable region ("HC") amino acid sequence |
| Ab 306 | 612 | DIQLTQSPATLSVSPGERATLSCRASQSVSTNLAWYQQKRGQAPRLLIYGASTRAIGI PARFSGSGSGTEFTLTISSLQSEDFAVYYCQQYNNMPPAYTFGQGTKVDIK | ADI-21058 | Light chain variable region ("LC") amino acid sequence |
| Ab 307 | 613 | QVQLVQSGAEVKRPGDSLKISCKGSGYSFTTSWIGWVRQVPGKGLEWMGIIYPGD SNTVYGPSLQQVTISADKSTNTAYLQWSSLKASDTAMYYCARRDGGTDYLSDAF DIWGQGTFVTVSS | ADI-21059 | Heavy chain variable region ("HC") amino acid sequence |
| Ab 307 | 614 | DIQMTQSPSSLSASVGDRVTITCRTSQNIVLYLNWYQQKPGKAPKLLIFAASSLPSGV PSRFSGSGSGTDFTLTISSLQPEDVATYYCQQSYNTPGTFGQGTKVDIK | ADI-21059 | Light chain variable region ("LC") amino acid sequence |
| Ab 308 | 615 | EVQLVESGGGLVKPGGSLRLSCEASGFRLSDYYMTWIRQAPGKGLECISYISGGSTF KSYSDSVKGRFTISRDNTNLYLQMNSLRVEDTAVYYCARAPYLIIYMDVWGKGTTV TVSS | ADI-21060 | Heavy chain variable region ("HC") amino acid sequence |
| Ab 308 | 616 | QPVLTQPPSVSGAPGQRVSICTGSSNIGAGYDVHWYQQLPGTPKLLIYDNNN RPSGVPDRFSGSKSGTSASLAITGLQAEDEADYYCQSYDNRLSGSQVLFGGGTKVTV L | ADI-21060 | Light chain variable region ("LC") amino acid sequence |
| Ab 309 | 617 | QVQLVQSGAEVKKPGSSVKVSCKASGGTFSNYPISWVRQAPGHGLEWMGRVVPT VGLANYAQNLQGRVTITADTSTNTVMELRSLRSEDTGLYYCARRAVVDTYAFDIW GQGTLVTVSS | ADI-21061 | Heavy chain variable region ("HC") amino acid sequence |
| Ab 309 | 618 | QSALIQPASVSGFPGQSITISCTGASSDVGGYNFVSWYQQHPGKAPKLIIYEVTKRPS GVSNRFSGSESGNTASLTISGLQAEDEADYYCSSFRYTSSIVYVFGSGTKVTVL | ADI-21061 | Light chain variable region ("LC") amino acid sequence |
| Ab 310 | 619 | EVQLLESGGGLVKPGGSLRLSCAASGFTFSDYDMINVRQAPGKGLEWVSSISRGSD YIYYADSLKGRFTISRDNARNSVTLQMNSLRAGDTALYFCARAELLDSGGYYLYFD HWGQGTLVTVSS | ADI-21062 | Heavy chain variable region ("HC") amino acid sequence |
| Ab 310 | 620 | DIRMTQSPSSLSASVGDRVTITCRASQIIASYVNWYQKKPGKAPKVLIYAASRLQNG VPSRFSGSGSGTEFTLTISSLQPEDFATYYCQQSYSTSFTPGQGTKVDIK | ADI-21062 | Light chain variable region ("LC") amino acid sequence |
| Ab 311 | 621 | EVQLVESGGGLVQPGGSLRLSCAASGFTFRTYVMQWVRQAPGKGLEYVSALSSDG GSTDYADSVKGRFTVSRDNSKNTLYLQMSSLRAEDTAVYYCVKRGEGGNDYLYYY MDVWGKGTTVTVSS | ADI-21063 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 311 | 622 | DIQVTQSPSSLSASVGDRVTITCRASQSITNYLNWYQQKPGKAPKVLIYAASSLQSGVPSRFSGSGSGTDFTLTISSLQPEDFATYYCQQSYLRPPTFGGGTKVEIK | ADI-21063 | Light chain variable region ("LC") amino acid sequence |
| Ab 312 | 623 | EVQLVESGGEVKKPGASVKVSCKASGYIFSNHGVSWVRQAPGQGLEWMGWISAYNGNAIYAQNLQGRVILTIDTSTSTAYMELTSDDTAIYYCARESGATAAAVMDYWGQGTLVTVSS | ADI-21064 | Heavy chain variable region ("HC") amino acid sequence |
| Ab 312 | 624 | DIVLTQTPLSLPVILGQPASISCRSSQSLVYSDGNTYLTWFQQRPGQSPRRLIYKVSNRDSGVPDRFSGSGSDTDFTLKISRVEAEDVGVYYCMQGIDWPRTFGQGTKVDIK | ADI-21064 | Light chain variable region ("LC") amino acid sequence |
| Ab 313 | 625 | EVQLLESGGGLVQPGGSLRLSCAASGFTSSYAMNWVRQAPGKGLEWVSGISGSGESTYYADSVKGRFTISRDSSKNTVLQMNSLRADDTAVYYCAKDQGYGVVVPAATRALPPRRYGMDVWGQGTTVTVSS | ADI-21065 | Heavy chain variable region ("HC") amino acid sequence |
| Ab 313 | 626 | EIVLTQSPGTLSLSPGERATLSCRASQSVSSTYLAWYQQKPGQAPRLLIYGASSRATGIPDRFSGSGSGTDFTLTITRLEPEDFAVYYCQQYGSSPPLTFGGGTKVDIK | ADI-21065 | Light chain variable region ("LC") amino acid sequence |
| Ab 314 | 627 | QVQLQESGPGLVKPSGTLSLICVVSGGSIKSHNYWTWVRQPPGKGLEWVGEIYQSGRTNYNPSLNSRVTLSMDKSKNQLSLRLTSVTAADTAVYFCVGGGPPAPYFQTWGQGTLVTVSS | ADI-21068 | Heavy chain variable region ("HC") amino acid sequence |
| Ab 314 | 628 | QSVLTQPPSVSGAPGQRVTISCTGSSSNIGAGYDVHWYQQLPGTAPKLLIYNNNNRPSGVPDRFSGSKSGTSASLAITGLQAEDEADYYCQSYDTSLSGYVFGTGTKVTVL | ADI-21068 | Light chain variable region ("LC") amino acid sequence |
| Ab 315 | 629 | EVQLVESGAEVRKPGASVKVSCKASGYTFSSNAISWVRQAPGQGLEWMGYISVFNGNTKYAQNLQGRVTMTDTAISTVYMELRSLRYDDTAIYYCARESLGMGGFYFDHWGQGTLVTVSS | ADI-21069 | Heavy chain variable region ("HC") amino acid sequence |
| Ab 315 | 630 | SYELTQPPSVSVAPGQTARITCGANNIGSDSVHWYQQKPGQAPVLVVFDDRDRPSGIPERFSGSNSGNTATLTISRVEAGDEADYYCQVWMTSDRSVFGGGTKLTVL | ADI-21069 | Light chain variable region ("LC") amino acid sequence |
| Ab 316 | 631 | EVQLVESGGGLVQPGGSLRLSCAASGFTFSRYAMGWVRQAPGKGLEWVSTISDSGGSTFYADSVEGRFTIARDSKNTLSLHMNSLRAEDTAIYYCAREAYSSSWYSGGWFDRWGQGTLVTVSS | ADI-21070 | Heavy chain variable region ("HC") amino acid sequence |
| Ab 316 | 632 | ETTLTQSPATLSVSPGERATLSCRASQSVSSNLAWYQQKPGQAPRLLIYGASTRATGIPARFSGSGSGAEFLTINSLQSEDFAIYYCQQYNNWPQTTFGQGTKVDIK | ADI-21070 | Light chain variable region ("LC") amino acid sequence |
| Ab 317 | 633 | EVQLVESGGGVVQPGKSLRLSCAVSGFTFSDHDMHWVRQAPGKGLEWVAAIWSDRTTKYYGDFVKGRFTISRDNSKNTLYLQMNSLRAEDTAVYYCARGQIYKSGGYYLVHLDHWGQGTLVTVSS | ADI-21071 | Heavy chain variable region ("HC") amino acid sequence |
| Ab 317 | 634 | DIQVTQSPSSLSASVGDRVTITCRASQSIASYLNWYQQKPGKAPNLLIYAASNLQSEVPSRFSGSGSGTDFTLTISGLQPEDFATYYCQQSYNIRLLTFGGGTKVEIK | ADI-21071 | Light chain variable region ("LC") amino acid sequence |
| Ab 318 | 635 | QVQLVESGGGLVKPGGSLRLSCEASGFNFRSYHMSWVRQAPGKGLEWVSSITAGSSYINYADSVKGRFTISRDNAKNSVLQMNSLSAEDTAVYYCAREGLNMGVGGTWFDPWGQGTLVTVSS | ADI-21072 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 318 | 636 | QAVVTQEPSVSGAPGQRVTISCTGSSNIGAGYDVHWYQQLPGTAPKLLIYGNNN RPSGVPDRFSGSKSATSASLAITGLQADDEADYYCQSYDRSLSGSWVFGIGTKVTVL | ADI-21072 | Light chain variable region ("LC") amino acid sequence |
| Ab 319 | 637 | EVQLVESGGGLVRPGRSLRLSCAASGFTFSMFSMNWVRQAPGKGLEWLAYIGGS GSTIDYANSVSGRFTISRDNAKNSLYLQMNSLRDEDTAVYYCARIGLQTYNSHSSSSS PARAFDVWGQGTTVTVSS | ADI-21073 | Heavy chain variable region ("HC") amino acid sequence |
| Ab 319 | 638 | DIVLTQSPSSLSASVGDRVTITCRASQSIGRFLNWYQQKPGKAPKLLIYAASSLESGV PSRFSGSGSGTQFSLTISSLQPEDFTTYYCQQSYSTPTFGGGTKVDIK | ADI-21073 | Light chain variable region ("LC") amino acid sequence |
| Ab 320 | 639 | EVQLVESGGGLVKPGGSLRLSCAASGFSFSNYYMSWVRQAPGKGLEWISYISGGST YANLADSVKGRFTISRDNTKNSMYLQMTSLRPDDTAVYYCARIHGTHGPFYFDYW GQGTLVTVSS | ADI-21075 | Heavy chain variable region ("HC") amino acid sequence |
| Ab 320 | 640 | QSVLTQPPSVSGAPGQRVTISCTGSSNIGAGYDVHWYQQLPGTAPKLLIHANSNR PSGVPDRFSGSKSGTSASLAITGLQAEDEADYYCQSYDNSLNAYVVFGTGTKLTVL | ADI-21075 | Light chain variable region ("LC") amino acid sequence |
| Ab 321 | 641 | EVQLVESGGGLVRPGGSLRLSCAASGFTFSSYAMDWVRQAPGKGLEWVSSISASSS FISYTDSVKGRFTISRDNAKNSLFLQMDNVTAEDTAVYYCARDYYESGRYFYGNPFD IWGQGTMVTVSS | ADI-21076 | Heavy chain variable region ("HC") amino acid sequence |
| Ab 321 | 642 | QPVLTQPPSVSGAPGQRVTISCTGSSNIGAGFDVHWYQQLPGTAPKLLIYANSDR PSGVPDRFSASKGTSASLAITGLQAEDEAHYYCQSYDNSLGGLCVFGIGTKLTVL | ADI-21076 | Light chain variable region ("LC") amino acid sequence |
| Ab 322 | 643 | QVQLVESGGGLVKPGGSLRLSCVVSGFTFRDYYMSWIRQAPGKGLEWISYISPSSTY TNYADSVRGRFTISRDNAENSLYLQMNSLRAEDTAVYYCARVNIAATGAGGVFLDY WGQGTTVTVSS | ADI-21077 | Heavy chain variable region ("HC") amino acid sequence |
| Ab 322 | 644 | QPVLTQPPSVSGAPGQRVTISCAGSSNIGAGYDVHWYQQLPGTAPKLLIYGNINR PSGVPDRFSGSKSGTSASLAITGLQAEDEADYYCQSYDSSLSGSYVFGIGTKVTVL | ADI-21077 | Light chain variable region ("LC") amino acid sequence |
| Ab 323 | 645 | EVQLVESGGGLVKPGGSLRLSCAASGFRLSDYYMSWIRQAPGKGLEWISDISGGST YTNYADSVKGRLTISRDNAQNSLYLQMNSLRAEDTAVYYCARWGSGGPDAFHFW GQGTTVTVSS | ADI-21078 | Heavy chain variable region ("HC") amino acid sequence |
| Ab 323 | 646 | QSVLTQPPSVSGVPGQRVTISCTGSRSNIGAGYDVHWYRQLPGTAPKLLIYGNSNR PSGVPDRFSGSKSGTSASLAITGLQADDEADYYCQSYDSSLSGSVIFGGGTKVTVL | ADI-21078 | Light chain variable region ("LC") amino acid sequence |
| Ab 324 | 647 | EVQLLESGGGLVKPGGSLRLSCAASGFTFSDYYMSWIRQAPGKGLEWVSNISGGST YTNYADSVKGRFTISRDNAKNSLYLQMNSLRAEDTAVYYCAREAYGSGNYYNPNW LDPWGQGTLVTVSS | ADI-21079 | Heavy chain variable region ("HC") amino acid sequence |
| Ab 324 | 648 | QSVLTQPPSVSGAPGQRVTISCTGSSNIGAGYDVHWYQQLPGTAPKLLIYGNRNR PSGVPDRFSGSKSGTSASLAITGLQAEDEADYYCQSYDSSLSGSVPFGGGTKLTVL | ADI-21079 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 325 | 649 | EVQLLESGGGLVKPGGSLRLSCEVSGPRLSDYYMSWIRQAPGKGLEWVSHISGGST YTNYADSVKGRFTISRDNGKKSMYLQMNSLRAEDTALYYCAKWGSGPEAFDIW GRGTMVTVSS | ADI-21080 | Heavy chain variable region ("HC") amino acid sequence |
| Ab 325 | 650 | QSALIQPPSVSGAPGQRVTISCTGSSSNIGAGYDVHWYQQIPGTAPKWYGNNNR PSGVPDRFSGSKSGTSASLAITGLQAEDEADYYCQSYDNSLSGSVVFGGGTKLTVL | ADI-21080 | Light chain variable region ("LC") amino acid sequence |
| Ab 326 | 651 | EVQLLESGGGLVKPGGSLRLSCAASRFAFSNYYMTWIRQAPGKGLEWISNISGGSTF TNYADSVKGRFTISRDNAKNSVHLQMNSLRAEDTAVYYCVREASVAAGTPGFDI WGQGTMVTVSS | ADI-21081 | Heavy chain variable region ("HC") amino acid sequence |
| Ab 326 | 652 | QSVLTQPPSVSGAPGQRVIISCTGSSSNIGAGYDVNWYQQLPGTAPKLLMYGNRN RASGVPDRFSGSKSGTSASLAITGLQAEDEADYYCHSYDSSLGGSVFGGGTKLTVL | ADI-21081 | Light chain variable region ("LC") amino acid sequence |
| Ab 327 | 653 | EVQLVESGGGLVKPGGSLKLSCVASGLKFSSYSMNWVRQAPGKGLEWVSSVSAGS SYTNYADSVKGRFTISRDNAKNSLYLQMNSLRVDDTAVYYCATERCSGGSCYLHGF DPWGQGTTVTVSS | ADI-21082 | Heavy chain variable region ("HC") amino acid sequence |
| Ab 327 | 654 | QSVLTQPPSVSGAPGQRVTISCTGSSSNIGAGYDVHWYQQLPGTAPKLLIFDNIIRP SGVPDRFSGSKSGTSASLAITGLQADDEADYYCQSYDKSGDYVFGTGTKVTVL | ADI-21082 | Light chain variable region ("LC") amino acid sequence |
| Ab 328 | 655 | QVQLQESGPGLVKPSGTLSLICAVSGDSITTSNMWSWVRQPPGKGLEWIGEIYHS GVTRYNPSLKSRLSISLDKSRNQFSLKLSSVTAADTAVYYCARDEALFGHMFDPWG QGTLVTVSS | ADI-21083 | Heavy chain variable region ("HC") amino acid sequence |
| Ab 328 | 656 | QSVLTQPPSVSPGQVTISCTGSSSDIGSYNYVSWYQQHPGKAPKLMLYDVSKR PSGVPDRFSGSKVKTASLTISGLQAEDEADYCCTYAGNSVVFGGGTKLTVL | ADI-21083 | Light chain variable region ("LC") amino acid sequence |
| Ab 329 | 657 | EVQLVESGAEVKKPGASVTVSCKKASGYTFTSNTISWLRQAPGQGLEWLGWVSASN GNTKYAQKFQGRVTMTTDTSATTAYMEVRTLRHDDTAIYYCARDILDMGGFHFD NWGQGTTVTVSS | ADI-21084 | Heavy chain variable region ("HC") amino acid sequence |
| Ab 329 | 658 | SYVLTQPPSVSVAPGQTARITCGGNNIGNKHVHWYKQKPGGAPVLVVYDDSDRPS GIPERFSGSNSGNTATLTVSRVEAGDEADFYCQVWDNTNDHPVFGGGTKVTVL | ADI-21084 | Light chain variable region ("LC") amino acid sequence |
| Ab 330 | 659 | EVQLVETGGGLVKPGGSLRLSCEASGFNFRSYSMNWVRQAPCKGLEWVSSISASSS YINYADSVKGRFTISRDNSKNSLYLQMNSLRAEDTGVYYCARVLVHYYGMDVWG QGTTVTVSS | ADI-21085 | Heavy chain variable region ("HC") amino acid sequence |
| Ab 330 | 660 | QSVLTQPPSVSAAPGQRVTISCTGTSSNIGAGYDVHWYQQLPGRAPKLLIGNNNR PSGVPDRFSGSKSGTSASLAITGLQAEDEADYYCQTYDKTLMEIPGGGTKLTVL | ADI-21085 | Light chain variable region ("LC") amino acid sequence |
| Ab 331 | 661 | EVQLVETGGGLVKPGGSLRLSCAASPPAFSNYYMSWIRQAPGKGLEWISNISGGST FTNYADSVKGRFTISRDNARNSLYLLMNNLRTEDTAVYYCAREASVAAGTPEGFDV WGQGGTTVTVSS | ADI-21086 | Heavy chain variable region ("HC") amino acid sequence |
| Ab 331 | 662 | QSVVTQPPSVSGQRVTISCTGSSSNIGAGYDVNWYQQFPGTAPKLLIYGNRNR PSGVPARFSGSKSGASASLAITGLQAEDEADYYCHSYDSGLSGSVFGGGTKLTVL | ADI-21086 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 332 | 663 | EVQLVESGGGLVQPGGSLRLSCAASGFTFSGYEMNWVRQAPGKGLEMLSYISSSG GIIYYADSVKGRFTISRDNARNSLFLQMNSLRAEDTAVYSCARARLLDGFDIWGQGT MVTVSS | ADI-21087 | Heavy chain variable region ("HC") amino acid sequence |
| Ab 332 | 664 | DIQVTQSPSTLSASVGDRVTITCRASQSIGSMLAWYQQKPGKAPKLLIYKASSLESG VPSRFSGSGSGTEFTLTISSLQPDDFATYYCQQYNSYSYTFGQGTKVEIK | ADI-21087 | Light chain variable region ("LC") amino acid sequence |
| Ab 333 | 665 | EVQLLESGGGLVKPGGSLRLSCVASGRFTSYSMNWVRQAPGKGLEWVSSISASSS YVDYADSLKGRFTISRDNAQNSLFLQMNSLRAEDTAVYYCARDYDSGNYHSPFP MDVWGQGTTVTVSS | ADI-21089 | Heavy chain variable region ("HC") amino acid sequence |
| Ab 333 | 666 | QSVLTQPPSVSGAPGQRVTISCTGSRSNIGAGYDVHWYQQLPGTAPKLLIYGNNKR PSGVPDRFSGSKSGTSASLAITGLQAEDEADYYCQSYDSGPIFGGGTKVTVL | ADI-21089 | Light chain variable region ("LC") amino acid sequence |
| Ab 334 | 667 | EVQLLESGGGLVKPGGSLRLSCAASGFTSGFTFSDFYMSWIRLTPGKGLEWISYISTH STSTNYADSVRGRFIISRDDARNSLFLQMNSLRAEDTAVYYCAGYYYGSGSYFFDH WGQGTLVTVSS | ADI-21090 | Heavy chain variable region ("HC") amino acid sequence |
| Ab 334 | 668 | ETTLTQSPATLSVSPGERATLSCRASQSVSSNVAWYQQKPGQAPRLLIYSASSRDTG IPVRFSGSGSGTEFTLSISSLQSEDFAVYYCQQYSDWPTFGQGTKVEIK | ADI-21090 | Light chain variable region ("LC") amino acid sequence |
| Ab 335 | 669 | QVQLVQSGAEVKKPGESLRISCQYSAYGFSTYWISWVRQLPGKGLEMMGRIDPSD SHTTYSPSFQGHVTLSADKSISTVYLQWSSLKASDTAMYYCARHQEYSGSDLDSWG QGTLVTVSS | ADI-21091 | Heavy chain variable region ("HC") amino acid sequence |
| Ab 335 | 670 | QPVLTQPPSVSAAPGQRVTISCSGTRSNIGINFVSWYQQLPGTAPKLLIYDNNKRPS GIPDRFSGSKSGTSATLAITGLQTGDEADYYCGTWDSSLSALFGGGTKVTVL | ADI-21091 | Light chain variable region ("LC") amino acid sequence |
| Ab 336 | 671 | EVQLLESGGGVVQPGRSLRLSCVASGFTFSTYGVHWVRQAPGKGLEWVAVISYDG ANKDYADSVKGRFTISRDNSKNTLYLQMNSLRAEDTAVYYCAKMITRVLPGGFDR WGQGTLVTVSS | ADI-22756 | Heavy chain variable region ("HC") amino acid sequence |
| Ab 336 | 672 | EIVMTQSPGTLSLSPGERATLSCRASQSVSSAYLAWYQQKPGQAPLLIYDASRRAT GIPDRFSGSGSGTDFTLTISRLEPEDFAVYYCQQYGSSRFTFGQGTKVEIK | ADI-22756 | Light chain variable region ("LC") amino acid sequence |
| Ab 337 | 673 | EVQLLESGAEVKKPGASVKVSCKASGYTFSNYGISWVRQAPGQGLEMMGWISVY NGNTEYAQKFQGRLIMTTDTSTSTAYMELRSLRSDDTAVYYCARDPPAVAASFMD VWGQGTTVTVSS | ADI-22757 | Heavy chain variable region ("HC") amino acid sequence |
| Ab 337 | 674 | EIVLTQSPLSLPVTLGQPASISCRSSQSLVHSEGNTYLSWFQQRPGQSPRRLIYKVSN RDSGVPDRFSGSGSGTDFTLKISRVEAEDVGLYFCMQGTHWPPTFGGGTKVEIK | ADI-22757 | Light chain variable region ("LC") amino acid sequence |
| Ab 338 | 675 | QVQLVESGGGLVKPGGSLRLSCAASGFSISSYSMNWVRQAPGKGLEWVSSISGSSS YIYYGDSVKGRFTISRDNARNSLYLQMNSLRAEDTAVYYCARGDIAAAGTITYYFAH WGQGTLVTVSS | ADI-22758 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 338 | 676 | QSVLTQPPSVSGAPGQRVTISCTGSSSNIGAGYDVHWYQQLTGTAPKLLIFGNNNR PSGVPDRFSGSKSGTSASLAITGLQAEDEADYYCQSYDSSLSGAVFGGGTQLTVL | ADI-22758 | Light chain variable region ("LC") amino acid sequence |
| Ab 339 | 677 | EVQLLESGGGLVKPGGSLRLSCAASGFSFSSYTMNWVRQAPGKGLEWVSSITGGSS YIDYAGSLKGRFTISRDNAKNSLYLQMNSLRVEDTAVYYCARDFPNIAVGGKTLDY WGQGTLVTVSS | ADI-22759 | Heavy chain variable region ("HC") amino acid sequence |
| Ab 339 | 678 | QPVLTQPPSVSGAPGQRVTISCTGSSSNIGAGYDVHWFQQLPGTAPKLLIYVNNNR PSGVPDRFSGSKSGTSASLAITGLQAEDEADYYCQSYDRLSAVVFGGGTKVTVL | ADI-22759 | Light chain variable region ("LC") amino acid sequence |
| Ab 340 | 679 | EVQLVESGGGLVQPGRSLRLSCVASGFTFDDYAMHWVRQAPGKGLEWVSGIINW NSGGIGYADSVKGRFTISRDNTKNSLYLQMNSLRAEDTALYYCAKDGSALMGYGVE VWGQGTTVTVSS | ADI-22760 | Heavy chain variable region ("HC") amino acid sequence |
| Ab 340 | 680 | SYELTQPPSASGTPGQRVTISCSGSNSNIGNNYVNWYQQLPGTAPKLLIYRNNQWP SGVPDRFSASKSGTSASLAISGLRSEDEADYYCASMDDSLSALVFGGGTKLTVL | ADI-22760 | Light chain variable region ("LC") amino acid sequence |
| Ab 341 | 681 | EVQLVESGPGLVKPSQTLSLTCAISGDSVSSNSVAMNWIRQSPSRGLEWLGRTYYQ SKMYNDYAVSVKSRISVNPDTSKNQFSLQLNSLTPEDTAVYYCVRGCSWGFGWYF DLWGRGTLVTVSS | ADI-22762 | Heavy chain variable region ("HC") amino acid sequence |
| Ab 341 | 682 | QSVLTQPPSVSGAPGQRVTISCTGSSSNIGAIYDVHWYQQFPGTAPKLLIYGNTNRP SGVPDRFSGSKSGTSASLAITGLQAEDEADYYCQSYDSSLSGYVFGTGTKVTVL | ADI-22762 | Light chain variable region ("LC") amino acid sequence |
| Ab 342 | 683 | EVQLVESGGGLIQPGGSLRLSCAASGFTFSTYEMNWVRQAPGKGLEWVSSISTSGS TKDYAGSVKGRFTVSRDNAKNSLYLQMNSLRAEDTAIYYCARVYYYDSSGYYLALFD YWGQGTLVTVSS | ADI-22763 | Heavy chain variable region ("HC") amino acid sequence |
| Ab 342 | 684 | EIVLTQSPSSLSASVGDRVTITCRASQSIASYLNWYQQKPGKAPKLLIYAASSLRSGVP SRFSGSGSGTDFTLTISSLQPEDFATYYCQQSYSTPSLTFGGGTKLEIK | ADI-22763 | Light chain variable region ("LC") amino acid sequence |
| Ab 343 | 685 | QVQLVESGPGLVRPSGTLSLTCAVSGGSISGKNWWSWVRQPPGKGLEWIGEIDHS GSTNYNPSLKSRVTISVDKSKNQFSLKLSSVTAADTAVYYCARTGLYDSSGYYLYFN YWGQGTLVTVSS | ADI-22764 | Heavy chain variable region ("HC") amino acid sequence |
| Ab 343 | 686 | EIVMTQSPSSLSASVGDRVTITCRASQTIASYVNWYQQRPGKAPNLLIFAASNLQTG VPSRFRGSGSGTVFLTISSLQPEDFATYYCQQSYSTPRTFGQGTKVDIK | ADI-22764 | Light chain variable region ("LC") amino acid sequence |
| Ab 344 | 687 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARDRGDGYNYDYWGQ GTLVTVSS | ADI-22765 | Heavy chain variable region ("HC") amino acid sequence |
| Ab 344 | 688 | QPVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSVVGGGGTKVTVL | ADI-22765 | Light chain variable region ("LC") amino acid sequence |
| Ab 345 | 689 | EVQLVESGGGLVQPGRSLRLSCAASGFTFSRDNAKNSLYLQMNSLRAEDTALYYCAKDGRFSLSHTYYF NSGSIGYADSVKGRFTISRDNAKNSLYLQMNSLRAEDTALYYCAKDGRFSLSHTYYF DYWGQGTLVTVSS | ADI-22766 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 345 | 690 | QPVLTQPPSASGSPGQSVTISCTGTSSDVGGYNYVSWYQQHPGKAPKLMIYEVSKR PSGVPNRFSGSKSGNTASLIVSGLQAEDEADYYCSSYAGSNNLYVFGTGTKVTVL | ADI-22766 | Light chain variable region ("LC") amino acid sequence |
| Ab 346 | 691 | QVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCAREANWGVAFDIWGQ GTMVTVSS | ADI-22767 | Heavy chain variable region ("HC") amino acid sequence |
| Ab 346 | 692 | QSVVTQPPSVSGAPGQRVTISCTGSSNIGAGYDVHWYQQLPGTAPKLLIYGNSNR PSGVPDRFSGSKSGTSASLAITGLQAEDEADYYCQSYDSSLSYVFGIGTKVTVL | ADI-22767 | Light chain variable region ("LC") amino acid sequence |
| Ab 347 | 693 | EVQLVESGGGLVQPGGSLRLSCAASGFTFSSYEMNWVRQAPGKGLEWVSYISSSSG STIYYADSVKGRFTISRDNAKNSLYLQMNSLRAEDTAVYYCAKSYIYDSSGYYLYFDY WGQGTLVTVSS | ADI-22768 | Heavy chain variable region ("HC") amino acid sequence |
| Ab 347 | 694 | EIVMTQSPSSLSASVGDRVTITCRASQSISSYLNWYQQKPGKAPKLLIYAASSLQSGV PSRFSGSGSGTDFTLTISSLQPEDFATYYCQQSYSTPGTFGQGTKVDIK | ADI-22768 | Light chain variable region ("LC") amino acid sequence |
| Ab 348 | 695 | QVQLVQSGGGLVQPGGSLRLSCAASGFTFSDHYMDWVRQAPGKGLEWVGRTRN KANSYTTEYAASVKGRFTISRDDSKNSLYLQMNSLKTEDTAVYYCARVGYYYYGM DVWGQGTTVTVSS | ADI-22769 | Heavy chain variable region ("HC") amino acid sequence |
| Ab 348 | 696 | SYVLTQPPSVSVSPGQTASITCSGDKLGDKYACWYQQKPGQSPVLVIYQDSKRPSGI PERFSGSNSGNTATLTISGTQAMDEADYYCQAWDSSTPLFGGGTKVTVL | ADI-22769 | Light chain variable region ("LC") amino acid sequence |
| Ab 349 | 697 | QVTLKESGPALVKPTQTLTLTCTFSGFSLSTSGMCVSWIRQPPGKALEWLALIDWD DDKYYSTSLKTRLTISKDTSKNQVVLTMTNMDPVDTATYYCARSPGRAVAGTDYW GQGTLVTVSS | ADI-22770 | Heavy chain variable region ("HC") amino acid sequence |
| Ab 349 | 698 | SYELTQPPSVSVSPGQTASITCSGDKLGDKYACWYQQKPGQSTAVVFGGGTKLTVL | ADI-22770 | Light chain variable region ("LC") amino acid sequence |
| Ab 350 | 699 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARDYSSGWYIFDYWG QGTLVTVSS | ADI-22771 | Heavy chain variable region ("HC") amino acid sequence |
| Ab 350 | 700 | QPVLTQPPSVSGAPGQRVTISCTGSSNIGAGYDVHWYQQLPGTAPKLLIYGNSNR PSGVPDRFSGSKSGTSASLAITGLQAEDEADYYCQSYDSSLSGSVFGGGTKLTVL | ADI-22771 | Light chain variable region ("LC") amino acid sequence |
| Ab 351 | 701 | EVQLVESGGGVVQPGRSLRLSCAASGFTFSSYAMHWVRQAPGKGLEWVAVISYD GSNKYYADSVKGRFTISRDNSKNTLYLQMNSLRAEDTAVYYCARAVEQQLFIWYYG MDVWGQGTTVTVSS | ADI-22772 | Heavy chain variable region ("HC") amino acid sequence |
| Ab 351 | 702 | SYELIQPPSVSVSPGQTASITCSGDKLGDKYACWYQQKPGQSPVLVIYQDSKRPSGI PERFSGSNSGNTATLTISGTQAMDEADYYCQAWDSSTDVVFGGGTQLTVL | ADI-22772 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 352 | 703 | QVQLVQSGAEVKKPGASVKVSCKASGYTFTSYGISNVRQAPGQGLEMMGWISAY NGNTNYAQKLQGRVTMTDTSTAYMELRSLRSDDTAVYYCARESALSRDGYNY GDVDYWGQGTLVTVSS | ADI-22773 | Heavy chain variable region ("HC") amino acid sequence |
| Ab 352 | 704 | ETTLTQSPLSLPVTLGQPASISCRSSQSLVUSDGNTYLNWFQQRPGQSPRRLIYKVSN RDSGVPDRFSGSGSGTDFTLKISRVEAEDVGYYCMQGTHWPTFGQGTKLEIK | ADI-22773 | Light chain variable region ("LC") amino acid sequence |
| Ab 353 | 705 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCAREGASGYNYRYFDY WGQGTLVTVSS | ADI-22774 | Heavy chain variable region ("HC") amino acid sequence |
| Ab 353 | 706 | QSVLTQPPSVSGAPGQRVTISCTGSSSNIGAGYDVHWYQQFPGAAPKLLIYGNNN RPSGVPDRFSGSKSGTSASLAITGLQADDEADYYCQSYDSSLSGYVVFGGGTKLTVL | ADI-22774 | Light chain variable region ("LC") amino acid sequence |
| Ab 354 | 707 | EVQLLESGGGVVQPGRSLRLSCAASGFTFSDYGMHNVRQAPCKGLEMVAVIWYD GSYKYADSVKGRFTISRDNSKNTLFLQMNSLRAEDTAVYYCARESLQTHDAFDIW GQGTMVTVSS | ADI-22775 | Heavy chain variable region ("HC") amino acid sequence |
| Ab 354 | 708 | DIQMTQSPSSLSASVGDRVTITCRASQGISNSLAWYQQKPGKAPKLLLYAASRLESG VPSRFSGSGSGTDYTLTINSLQPEDFATYFCQQYYSTLTWTFGQGTKVDIK | ADI-22775 | Light chain variable region ("LC") amino acid sequence |
| Ab 355 | 709 | EVQLLESGGGLVKPGGSLRLSCAASGFTFSDYYMSWIRQAPGKGLEWVSYISSSGST IYYADSVKGRFTISRDNAKNSLYLQMNSLRAEDTAVYYCAREIGGSYTGGAFDIWG QGTMVTVSS | ADI-22776 | Heavy chain variable region ("HC") amino acid sequence |
| Ab 355 | 710 | SYELTQPPSVSVAPGQTARITCGGNNIGSKSVHWYQQKPGQAPVLVVYDDSDRPS GIPERFSGSNSCNTATLTISRVEAGDEADYYCQVMDSSSDHVFGGGTKVTVL | ADI-22776 | Light chain variable region ("LC") amino acid sequence |
| Ab 356 | 711 | QVQLVQSGAEVKRPGASVKVSCKASEYTFNFHDINWVRQAPGQGLEWMGWMN PKSGNTGYAQKFQGRVTMTRDTSKNTAYLELSLRSEDTAVYYCARGYGTSWSSDS WWGQGTLVTVSS | ADI-22777 | Heavy chain variable region ("HC") amino acid sequence |
| Ab 356 | 712 | SYELTQLPSVSVSPGQTARITCSGDALSKQFVYWYQQKPGLAPMLVIYKDTNRPSW IPERFSGSGSGTTATLTISEVQAEDEADYYCQSVDNSGTYGWVFGGGTKVTVL | ADI-22777 | Light chain variable region ("LC") amino acid sequence |
| Ab 357 | 713 | EVQLVESGPGLVKPSETLSLTCTVSGGSINSYSWTWIRQPPGCKGLEMLGSFDYSGSN TYNPSLKSRVTIAVDTSKNQFSLKLTSATAADTAVYYCARAPVYDSSGYLYLYFDNW GQGTLVTVSS | ADI-22778 | Heavy chain variable region ("HC") amino acid sequence |
| Ab 357 | 714 | DIQMTQSPSSLSASVGDRVTITCRASQSIASYLNWYQQKPGKAPKLLIFAASNLHSG VPSRFSGSGSGTTFLTISSLQPEDFATYYCQQSYSIRFFTFGPGTKLEIK | ADI-22778 | Light chain variable region ("LC") amino acid sequence |
| Ab 358 | 715 | QVQLQQWGAGLLKPSETLSLTCAVYGGSFSDYSWTWIRQPPGKGLEWIGEISHTGI TNYNPSLKSRVNISVDTSKNQFSLKLSSVTAADTAVYYCARADAYDSSGYVYYFDY WGQGTLVTVSS | ADI-22779 | Heavy chain variable region ("HC") amino acid sequence |
| Ab 358 | 716 | DIQVTQSPPSLSASVGDRVTITCRASQTIASYLNWYHQKPGKAPELLIYAASSLQSGV PSRFSGSGSGSTAFTLTISSLQPEDFATYYCQQSYSAPPSFGGGTKVEIK | ADI-22779 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 359 | 717 | EVQLVESGPTLVKPTQTLTLTCTFSGFSLSTSGVGVGWIRQPPGKALEWLALIYWDD DKRYSPSLKSRLTITKDTSKNQVVLTMTNMDPVDTATYYCAHRGRQYSYGYYYFDY WGQGTLVTVSS | ADI-22780 | Heavy chain variable region ("HC") amino acid sequence |
| Ab 359 | 718 | QSVLIQPASVSGSPGQSITICTGTSSDVGGYNFVSWYQQHPGKAPKLMIYDVSNR PSGVSNRFSGSKSGNTASLTISGLQAEDEADYYCSSYTSSTLDVFGTGTKVTVL | ADI-22780 | Light chain variable region ("LC") amino acid sequence |
| Ab 360 | 719 | EVQLVESGGGLVQPGGSLRLSCAASGFTFSSYEMNWVRQAPGKGLEWVSIISSSG STIYYADSVKGRFTISRDNAKNSLYLQMNSLRAEDTAVYYCARGGAVAGTRTGGFDI WGQGTTVTVSS | ADI-22781 | Heavy chain variable region ("HC") amino acid sequence |
| Ab 360 | 720 | SYELTQPPSVSVSPGQTARITCSGDALPKQYAYWYQQKPGQAPVLVIYKDSERPSGI PERFSGSSSGTTVTLTISGVQAEDEADYYCQSADSSGTYQVFGGGTKLTVL | ADI-22781 | Light chain variable region ("LC") amino acid sequence |
| Ab 361 | 721 | EVQLVESGGGLVKPGGSLRLSCAASGFIFSDYYMSWIRQAPGKGLEWVSNISGGSS FTNYADSVKGRFTISRDNAKNSLYLQMNSLRAEDTAVYYCARDLGYCSSNSCLDAF DIWGQGTTVTVSS | ADI-24792 | Heavy chain variable region ("HC") amino acid sequence |
| Ab 361 | 722 | QSVLTQPPSVSGAPGQRVTISCTGSSNIGAGYDVHWYQQLPGTAPKLLIYGNTNR PSGVPDRFSGSRSGTSASLAITGLQAEDEADYYCQSYDSSLSGSLFGGGTKVTVL | ADI-24792 | Light chain variable region ("LC") amino acid sequence |
| Ab 362 | 723 | QVQLVQSGAEVKKPGESLKISCKGSGYSFTSYWIGWVRQMPGKGLEWMGIIYPGD SDTRYSPSFQGQVTISADKSISTAYLQWSSLKASDTAMFYCVMGSYSYFDYWGQG TLVTVSS | ADI-24793 | Heavy chain variable region ("HC") amino acid sequence |
| Ab 362 | 724 | NFMLTQPHSVSESPGKTVTICTRSSGSIASNYVQNVQQRPGSAPTTVIYEDNLRPS GVPDRFSGSIDSSSNSASLTISGLKTEDEADYYCQSYDSSNQVFGGGTKLTVL | ADI-24793 | Light chain variable region ("LC") amino acid sequence |
| Ab 363 | 725 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARVGYSSSSGAPDYWG QGTLVTVSS | ADI-24795 | Heavy chain variable region ("HC") amino acid sequence |
| Ab 363 | 726 | QSVLTQPPSVSGAPGQRVTISCTGSSNIGAGYDVHWYQQLPGTAPKLLIYGNSNR PSGVPDRFSGSKSGTSASLAITGLQAEDEADYYCQSYDSSLSGSVPFGGGTKVTVL | ADI-24795 | Light chain variable region ("LC") amino acid sequence |
| Ab 364 | 727 | QVQLVQSGGGVVQPGRSLRLSCAASGFTFSSYGMHWVRQAPGKGLEWVAVIWY DGSNKYYADSVKGRFTISRDNSKNTLYLQMNSLRAEDTAVYYCARTAYGSGSYPIYY YYMDVWGKGTTVTVSS | ADI-24796 | Heavy chain variable region ("HC") amino acid sequence |
| Ab 364 | 728 | SYELTQPPSVSVSPGQTASITCSGDKLGDKYACWYQQKPGQSPVLVIYQDSKRPSGI PERFSGSNSGNTATLTISGTQAMDEADYYCQAWDSSTVVFGGGTKLTVL | ADI-24796 | Light chain variable region ("LC") amino acid sequence |
| Ab 365 | 729 | EVQLLESGPGLVKPSETLSLTCTVSGGSISSYYWSWIRQPPGKGLEMIGYIYYSGSTN YNPSLKSRVTISVDTSKNQFSLKLSSVTAADTAVYYCARILGHCSGGSCYRIIDIWGQ GTLVTVSS | ADI-24798 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 365 | 730 | QPVLTQPPSVSVSPGQTASITCSGDKLGDKYACWYQQKPGQSPVLVIYQDSKRPSGIPERFSGSNSGNTATLTISGTQAMDEADYYCQAWDSTGVFGGGTKLTVL | ADI-24798 | Light chain variable region ("LC") amino acid sequence |
| Ab 366 | 731 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREGRDGYNYFDYWGQGTLVTVSS | ADI-24799 | Heavy chain variable region ("HC") amino acid sequence |
| Ab 366 | 732 | QSVLTQPPSVSGAPGQRVTISCTGSSNIGAGYDVHWYQQLPGTAPKLLIYGNSNRPSGVPDRFSGSKSGTSASLAITGLQAEDEADYYCQSYDSSLSGSVFGGGTKLTVL | ADI-24799 | Light chain variable region ("LC") amino acid sequence |
| Ab 367 | 733 | EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARVRGGYSYGYGMDVWGQGTTVTVSS | ADI-24800 | Heavy chain variable region ("HC") amino acid sequence |
| Ab 367 | 734 | QSVVTQPPSVSGAPGQRVTISCTGSSNIGAGFDVHWYQQLPGTAPKLLIYGNSNRPSGVPDQFSGSKSGTSASLAITGLQAEDEADYYCQSYDSLSGVVFGGGTKLTVL | ADI-24801 | Light chain variable region ("LC") amino acid sequence |
| Ab 368 | 735 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVTARTFGGIRKGYYYGMDVWGQGTTVTVSS | ADI-24801 | Heavy chain variable region ("HC") amino acid sequence |
| Ab 368 | 736 | SYELTQPPSVSVSPGQTASITCSGDKLGDKYACWYQQKPGQSPVLVIYQDSKRPSGIPERFSGSNSGNTATLTISGTQVMDEADYYCQAWDSSTVVFGGGTKLTVL | ADI-24803 | Light chain variable region ("LC") amino acid sequence |
| Ab 369 | 737 | EVQLLESGGGLVLPGGSLRLSCAASGFTFSSYAMSWVRQAPGKGLEWVSAISGSGIYTYYADSVKGRFTISRDNSKNTLYLQMSSLRAEDTAVYYCAKGSLGMAYSAFDIWGLGTTVTVSS | ADI-24803 | Heavy chain variable region ("HC") amino acid sequence |
| Ab 369 | 738 | DIQLTQSPGTLSLSSGERATLSCRASQSVSSNYLAWYQQKPGQPPRLLIYGASSRATGIPDRFSGSGSGTDFTLTISRLEPEDFAVYYCQQYGSSPLTFGGGTKVDIK | ADI-24805 | Light chain variable region ("LC") amino acid sequence |
| Ab 370 | 739 | QVQLVQSGGGLVKPGGSLRLSCAASGFTFSSYSMNWVRQAPGKGLEWVSSISSSSSSYIYYADSVKGRFTISRDNAKNSLYLQMNSLRAEDTAVYYCAREGYSSSSGYYYMDVWGKGTTVTVSS | ADI-24805 | Heavy chain variable region ("HC") amino acid sequence |
| Ab 370 | 740 | QSVLTQPPSVSGAPGQRVTISCTGSSNIGAGYDVHWYQQLPGTAPKLLIYGNSNRPSGVPDRFSGSKSGTSASLAITGLQAEDEADYYCQSYDSSLSGSVFGIGTKVTVL | ADI-24807 | Light chain variable region ("LC") amino acid sequence |
| Ab 371 | 741 | EVQLVESGPGLVKPSETLSLLCTVSGGSISSSSYYMGWIRQPPGKGLEWIGSIYYSGSTYYNPSLKSRVTISVDTSKNQFSLKLSSVTAADTAVYYCARHVNPYYDSSGTPYYYYGMDVWGQGTTVTVSS | ADI-24807 | Heavy chain variable region ("HC") amino acid sequence |
| Ab 371 | 742 | SYELTQPPSVSVSPGQTASITCSGDKLGDKYACWYQQKPGQSPVLVIYQDSKRPSGIPERFSGSNSGNTATLTISGTQAMDEADYYCQAWDSGTVVFGGGTKLTVL | ADI-24808 | Light chain variable region ("LC") amino acid sequence |
| Ab 372 | 743 | QVQLVQSGAEVKKPGASVKVSCKASGYTFTGYYMHWVRQAPGQGLEWMGWINPNSGGTNYAQKPQGWVTMTRDTSISTAYMELSRLRSDDTAVYYCARGDPAANDYWGQGTLVTVSS | ADI-24808 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 372 | 744 | QPVLTQPPSASGSPGQSVTISCTGTSSDVGGYNYVSWYQQHPGKAPKLMIYEVSKR PSGVPDRFSGSKSGNTASLIVSGLQAEDEADYYCSSYAGSNNVFGGGTKLTVL | ADI-24808 | Light chain variable region ("LC") amino acid sequence |
| Ab 373 | 745 | QVQLVQSGAEVKKPGASVKVSCKASGTFTSYDINWVRQATGQGLEWMGWMN PNSGNTGYAQKFQGRVTMTRNTSISTAYMELSSLRSEDTAVYYCARGLPGQWLEY YFDYWGQGTLVTVSS | ADI-24811 | Heavy chain variable region ("HC") amino acid sequence |
| Ab 373 | 746 | SYVLTQPPSVSVAPGKTARITCGGNNIGSKSVHWYQQKPGQAPVLVIYDSDRPSGI PERFSGSNSGNTATLTISRVEAGDEADYYCQVWDSSDHPVFGGGTKVTVL | ADI-24811 | Light chain variable region ("LC") amino acid sequence |
| Ab 374 | 747 | EVQLVESGGGLVQPGGSLRLSCAASGFSFSTYAMSWVRQAPGKGLEWVSAISGGG GSTYYADSVKGRFTISRDNSKNTLYLQVNSLRAEDTAVYYCARGGYCSSDSCYPFDF WGQGTLVTVSS | ADI-24812 | Heavy chain variable region ("HC") amino acid sequence |
| Ab 374 | 748 | QPVLTQPPSVSVSPGQTAMITCSGDALPKQYAYWYQQKPGQAPVLVIYKDSERPS GIPERFSGSSSGTTVTLTISGVQAEDEADYYCQSADNSGSYAVFGGGTQLITVL | ADI-24812 | Light chain variable region ("LC") amino acid sequence |
| Ab 375 | 749 | EVQLLESGGGLVQPGRSLRLSCAASGFTFDDYAMHWVRQAPGKGLEWVSGISWN SGSIGYADSVKGRFTISRDNAKNSLYLQMNSLRAEDTALYYCAKDGDSSSWRDSNF DYWGQGTLVTVSS | ADI-24813 | Heavy chain variable region ("HC") amino acid sequence |
| Ab 375 | 750 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGVFGGGTKLTVL | ADI-24813 | Light chain variable region ("LC") amino acid sequence |
| Ab 376 | 751 | EVQLLESGGGVVQPGRSLRLSCAASGFTFNSYTMHWVRQAPGKGLEWVAVLSYD GSNKYYADSVKGRFTISRDNSKNTLYLQMNSLRAEDTAVYYCARGRPYDFWSGYYT DYYYYMDVWGKGTTVTVSS | ADI-24814 | Heavy chain variable region ("HC") amino acid sequence |
| Ab 376 | 752 | EIVLTQSPGTLSLSPGERATLSCRASQSVYSNYLAWYQQKPGQAPRLLIYGASSRAT GIPDRFSGSGSGTDFLTISRLEPEDFAVYYCQQCGSSWTFGQGTKVEIK | ADI-24814 | Light chain variable region ("LC") amino acid sequence |
| Ab 377 | 753 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCAREGYSSSSGYYYMDV WGKGTTVTVSS | ADI-24815 | Heavy chain variable region ("HC") amino acid sequence |
| Ab 377 | 754 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGSVFGIGTKVTVL | ADI-24815 | Light chain variable region ("LC") amino acid sequence |
| Ab 378 | 755 | QVQLVQSGAEVKKPGASVKVSCKASGTFTSYDINWVRQATGQGLEWMGWMN PNSGNTGYAQKFQGRVTMTRNTSISTAYMELSSLRSEDTAVYYCARGIPGYYYGM DVWGQGTTVTVSS | ADI-24816 | Heavy chain variable region ("HC") amino acid sequence |
| Ab 378 | 756 | SYELTQPPSVSVSPGQTASITCSGDKLGDKYACWYQQKPGQSPVLVIYQDSKRPSGI PERFSGSGSNSGNTATLTISGTQAMDEADYYCQAWDSSTYVFGIGTKVTVL | ADI-24816 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 379 | 757 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARDSMALLYSNYWFDP WGQGTLVTVSS | ADI-24817 | Heavy chain variable region ("HC") amino acid sequence |
| Ab 379 | 758 | QSVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGSVFGGGTKLTVL | ADI-24817 | Light chain variable region ("LC") amino acid sequence |
| Ab 380 | 759 | QVQLVQSGAEVKKPGASVKVSCKASGYTFTGYYMHWVRQAPGQGLEWMGWIN PNSGGTNYAQKFQGRVTMTRDTSISTAYMELSRLRSDDTAVYYCARGGTGVEFDY WGQGTLVTVSS | ADI-24818 | Heavy chain variable region ("HC") amino acid sequence |
| Ab 380 | 760 | QPVLTQPASVSGSPGQSITISCTGTSSDVGGYNYVSWYQQHPGKAPKLMIYDVSNR PSGVSNRFSGSKSGNTASLTIISGLQAEDEADYYCSSYTSSSTLVFGGGTQLTVL | ADI-24818 | Light chain variable region ("LC") amino acid sequence |
| Ab 381 | 761 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCARESGSGWYIFDYWG QGTLVTVSS | ADI-24819 | Heavy chain variable region ("HC") amino acid sequence |
| Ab 381 | 762 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDGSLSGYVFGGGTKVTVL | ADI-24819 | Light chain variable region ("LC") amino acid sequence |
| Ab 382 | 763 | QVQLVQSGAEVKKPGSSVKVSCKASGFTFSSYTISWVRQAPGQGLEWMGRIIPILG IANYAQKFQGRVTITADKSTSTAYMELSSLRSEDTAVYYCARDPPYLRAFDIWGQGT TVTVSS | ADI-24820 | Heavy chain variable region ("HC") amino acid sequence |
| Ab 382 | 764 | ETTLIQSPSSLSASVGDRVTITCRASQSISSYLNWYQQKPGKAPKLLIYAASSLQSGV PSRFSGSGSGTDFTLTISSLQPEDFATYYCQQSYSTPLLTFGGGTKVEIK | ADI-24820 | Light chain variable region ("LC") amino acid sequence |
| Ab 383 | 765 | EVQLVESGGGLVQPGRSLRLSCAASGFTFDDYAMHWVRQAPGKGLEWVSGISW NSGSIGYADSVKGRFTISRDNAKNSLYLQMNSLRAEDTALYYCAKDKDNWNYDAF DIWGQGTMVTVSS | ADI-24821 | Heavy chain variable region ("HC") amino acid sequence |
| Ab 383 | 766 | SYELTQPPSASGTPGQRVTISCSGSSSNIGSNTVNWYQQLPGTAPKLLIYSNNQRPS GVPDRFSGSKSGTSASLAISGLQSEDEADYYCAAWDDSLNGPVFGGGTKLTVL | ADI-24821 | Light chain variable region ("LC") amino acid sequence |
| Ab 384 | 767 | QVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARDSGLGSRGDAFDIW GQGTMVTVSS | ADI-24822 | Heavy chain variable region ("HC") amino acid sequence |
| Ab 384 | 768 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYVFGIGTKVTVL | ADI-24822 | Light chain variable region ("LC") amino acid sequence |
| Ab 385 | 769 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCAREGDYYGSGRPFDYW GQGTMVTVSS | ADI-24823 | Heavy chain variable region ("HC") amino acid sequence |
| Ab 385 | 770 | QSVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGSVVFGGGTKLTVL | ADI-24823 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 386 | 771 | QVQLQESGPGLVKPSETLSLTCTVSGGSISSYYWSWIRQPPGKGLEWIGYIYYSGST NYNPSLKSRVTISVDTSKNQFSLKLSSVTAADTAVYYCAISLYGDYRTDAPDIWGQGT TVTVSS | ADI-24824 | Heavy chain variable region ("HC") amino acid sequence |
| Ab 386 | 772 | EIVLTQSPSSFSASTGDRVTITCRASQGISSYLAWYQQKPGKAPKLLIYAASTLQSGVP SRFSGSGSGTDFTLTISCLQSEDFATYYCQQYYSYPLFGGGTKVEIK | ADI-24824 | Light chain variable region ("LC") amino acid sequence |
| Ab 387 | 773 | QVQLVQSGAEVKKPGASVKVSCKASGYTFTFSYDINWVRQATGQLEWMGWMN PNSGNTGYAQKFQGRVTMTRNTSISTAYMELSSLRSEDTAVYYCSSVGGYYYGM DVWGQGTTVTVSS | ADI-24825 | Heavy chain variable region ("HC") amino acid sequence |
| Ab 387 | 774 | EIVMTQSPLSLPVTPGEPASISCRSSQSLLHSNGYNYLDWYLQKPGQSPQLLIYLGSN RASGVPDRFSGSGSGTDFTLKISRVEAEDVGVYYCMQALQTLYTFGQGTKVEIK | ADI-24825 | Light chain variable region ("LC") amino acid sequence |
| Ab 388 | 775 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARDRGYGSGALDYWG QGTLVTVSS | ADI-24826 | Heavy chain variable region ("HC") amino acid sequence |
| Ab 388 | 776 | QPVLTQPASVSGSPGQSITISCTGTSSDVGGYNYVSWYQQHPGKAPKLMIYDVSNR PSGVSNRFSGSKSGNTASLTISGLQAEDEADYYCSSYTSSSTVVFGGGTKLTVL | ADI-24826 | Light chain variable region ("LC") amino acid sequence |
| Ab 389 | 777 | EVQLVESGGGLVQPGGSLRLSCAASGFTVSSNYMSWVRQAPGKGLEWVSVIYSDG STYYADSVKGRFTISRHNSKNTLYLQMNSLRAEDTAVYYCARCSTYGDYIDWYFDL WGRGTLVTVSS | ADI-24827 | Heavy chain variable region ("HC") amino acid sequence |
| Ab 389 | 778 | ETTLTQSPSGSGTEFTLTISSLQSEDFAVYYCQQYNNWPLSFGGGTKLEIK SVSPGERATLSCRASQSVSSNLAWYQQKPGQAPRLLIYGASTRATG IPARFSGSGSGTEFTLTISSLQSEDFAVYYCQQYNNWPLSFGGGTKLEIK | ADI-24827 | Light chain variable region ("LC") amino acid sequence |
| Ab 390 | 779 | EVQLVESGGGLVKPGGSLRLACAASGFSFRSYRMNWVRQAPGKGLEWVSSISSSSS YIDYADSVKGRFTISRDNAKNTVYLQVNSLRAEDTAVYYCARDGRTIFGVVIDYWG QGTLVTVSS | ADI-24828 | Heavy chain variable region ("HC") amino acid sequence |
| Ab 390 | 780 | QSVLTQPPSVSGAPGQRVTISCTGSSSNIGAGYDVHWYQQLPGTAPKLLIYGNNNR PSGVPDRFSGSKSGTSASLVITGLQAEDEADYCQSYDSSLSVVFGGGTKLTVL | ADI-24828 | Light chain variable region ("LC") amino acid sequence |
| Ab 391 | 781 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCARGFHYYGSGSHDAFDI WGQGTMVTVSS | ADI-24829 | Heavy chain variable region ("HC") amino acid sequence |
| Ab 391 | 782 | QPVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGVFGGGTKLTVL | ADI-24829 | Light chain variable region ("LC") amino acid sequence |
| Ab 392 | 783 | QVQLVQSGAEVKKPGSSVKVSCKASGGTFSSYAISWVRQAPGQGLEWMGGIIPIF GTANYAQKFQGRVTITADESTSTAYMELSSLRSEDTAVYYCARGGSMVRGLGFDP WGQGTLVTVSS | ADI-24830 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 392 | 784 | DIQLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKLEIK | ADI-24830 | Light chain variable region ("LC") amino acid sequence |
| Ab 393 | 785 | QVQLVESGGGLVKPGGSLRLSCAASGFTFSSYSMNWVRQAPGKGLEWVSSISSSSYIYYADSVKGRFTISRDNAKNSLYLQMNSLRAEDTAVYYCARVPSDFWSGYNDYWGQGTLVTVSS | ADI-24831 | Heavy chain variable region ("HC") amino acid sequence |
| Ab 393 | 786 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSWVFGGGTKLTVL | ADI-24831 | Light chain variable region ("LC") amino acid sequence |
| Ab 394 | 787 | EVQLVESGGGLVKPGGSLRLSCAASGFTFSSYSMNWVRQAPGKGLEWVSSISASSSYIFYSDLVKGRFTISRDNAKNSLYLQMNSLRAEDTAVYYCARAGYYYGSGSYYVDYWGQGTLVTVSS | ADI-24832 | Heavy chain variable region ("HC") amino acid sequence |
| Ab 394 | 788 | QSVLTQPPSVSGAPGQPVAISCTGSSSNIGAGYDVHWYQQLPGTAPKLLIYGNSNRPSGVPDRFSGSKSGTSASLAITGLQAEDEADYYCQSYGSSLSGWVFGGGTKLTVL | ADI-24832 | Light chain variable region ("LC") amino acid sequence |
| Ab 395 | 789 | QVQLVESGGGLVKPGGSLRLSCAASGFTFSSYSMNWVRQAPGKGLEWVSSISSSSYIYYADSVKGRFTISRDNAKNSLYLQMNSLRAEDTAVYYCARALTYYDSSGHGADYWGQGTLVTVSS | ADI-24833 | Heavy chain variable region ("HC") amino acid sequence |
| Ab 395 | 790 | QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVVFGGGTKLTVL | ADI-24833 | Light chain variable region ("LC") amino acid sequence |
| Ab 396 | 791 | QVQLVQSGGGLVQPGGSLRLSCAASGFTFSSYAMSWVRQAPGKGLEWVSSTISGSGGSTYYADSVKGRFTISRDNSKNTLYLQMNSLRAEDTAVYYCATWKRWGSGYYYSYMDVWGKGTTVTVSS | ADI-24834 | Heavy chain variable region ("HC") amino acid sequence |
| Ab 396 | 792 | DIQLTQSPSTLSASVGDRVTITCRASQSISSWLAWYQQKPGKAPKLLIYDAFSLESGVPSRFSGSGSGTEFTLTISSLQPDDFATYYCQQYNSYSVTFGGGTKVEIK | ADI-24834 | Light chain variable region ("LC") amino acid sequence |
| Ab 397 | 793 | EVQLVESGGGLVKPGGSLRLSCAASGFPFSTISSMNWVRQAPGKGLEWVSSISSSSYIDYADSVKGRFTISRDNAKNSLYLQMNSLRAGDTAVYYCARVPRSDWYFPDYWGQGTLVTVSS | ADI-24835 | Heavy chain variable region ("HC") amino acid sequence |
| Ab 397 | 794 | QSVVTQPPSVSGAPGQRVTISCTGSSSNIGAGYDVHWYQQLPGTAPKFLIYDNKYRPSGVPDRFSGSKSGTSASLAITGLQAEDEADYYCQSYDSSLSGYVFGTGTKLTVL | ADI-24835 | Light chain variable region ("LC") amino acid sequence |
| Ab 398 | 795 | EVQLLESGGGLVQPGRSLRLSCAASGFTFDDYAMHWVRQAPGKGLEWVSGISWNSGSIGYADSVKGRFTISRDNAKNSLYLQMNSLRAEDTALYYCAKDLRGGTYYYGMDVWGQGTTVTVSS | ADI-24836 | Heavy chain variable region ("HC") amino acid sequence |
| Ab 398 | 796 | DIRVTQSPSSLSASVGDRVTITCRASQSISSYLNWYQQKPGKAPKLLIYAASSLQSGVPSRFSGSGSGTDFTLTISSLQPEDFATYYCQQSYSTPPTFGGGTKVEIK | ADI-24836 | Light chain variable region ("LC") amino acid sequence |
| Ab 399 | 797 | QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARAIYYDSSGYYYVGDAFDIWGQGTTVTVSS | ADI-24837 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 399 | 798 | QSVLTQPPSVSAAPGQKVTISCSGSSNIGNNYVSWYQQLPGTAPKLLIYENNKRPSGIPDRFSGSKSGTSATLGITGLQTGDEADYYCGTWDSSLSAGVFGGGTKLTVL | ADI-24837 | Light chain variable region ("LC") amino acid sequence |
| Ab 400 | 799 | EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARQGVGTWNYYYYYMDVWGKGTTVTVSS | ADI-24838 | Heavy chain variable region ("HC") amino acid sequence |
| Ab 400 | 800 | QSVVTQPPSVSGAPGQRVTISCTGSSNIGAGYDVHWYQQLPGTAPKLLIYGNSNRPSGVPDRFSGSKSGTSASLAITGLQAEDEADYYCQSYDSSLSWVFGGGTKLTVL | ADI-24838 | Light chain variable region ("LC") amino acid sequence |
| Ab 401 | 801 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVLVATAYGNAFDIWGQGTMVTVSS | ADI-24839 | Heavy chain variable region ("HC") amino acid sequence |
| Ab 401 | 802 | QSVLTQPPSVSGAPGQRVTISCTGSSNIGAGYDVHWYQQLPGTAPKLLIYGNSNRPSGVPDRFSGSKSGTSASLAITGLQAEDEADYYCQSYDSSLTVVFGGGTKLTVL | ADI-24839 | Light chain variable region ("LC") amino acid sequence |
| Ab 402 | 803 | EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARDQVYSYGYYFDYWGQGTLVTVSS | ADI-24840 | Heavy chain variable region ("HC") amino acid sequence |
| Ab 402 | 804 | QSVLAQPPSVSGAPGQRVTISCTGSSSNIGAGYDVHWYQQLPGTAPKLLIYGNSNRPSGVPDRFSGSKSGTSASLAITGLQAEDEADYYCQSYDSLSGSHVVFGGGTKLTVL | ADI-24840 | Light chain variable region ("LC") amino acid sequence |
| Ab 403 | 805 | QVQLVQSGAEVKKPGASVKVSCKASGYTFTSYAMHWVRQAPGQRLEWMGWINAGNGNTKYSQKPQGRVTITRDTSASTAYMELSSLRSEDTAVYYCARDGFPTNYDFWSGYSDDAFDIWGQGTMVTVSS | ADI-24841 | Heavy chain variable region ("HC") amino acid sequence |
| Ab 403 | 806 | DIVMTQSPATLSVSPGERATLSCRASQSVSSNLAWYQQKPGQAPRLLIYGASTRATGIPARFSGSGSGTEFTLTISLQSEDFAVYYCQQYNNWPPLTFGQGTKVDIK | ADI-24841 | Light chain variable region ("LC") amino acid sequence |
| Ab 404 | 807 | QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVPHDYGGYYFDYWGQGTLVTVSS | ADI-24842 | Heavy chain variable region ("HC") amino acid sequence |
| Ab 404 | 808 | QSVVTQPPSVSGAPGQRVTISCTGSSSNIGAGYDVHWYQQLPGTAPKLLIYRNSNRPSGVPDRFSGSKSGTSASLAIIGLQAEDEADYYCQSYDSSLSVVFGGGTKLTVL | ADI-24842 | Light chain variable region ("LC") amino acid sequence |
| Ab 405 | 809 | EVQLVESGPGLVKPSQTLSLTCTVSGGSISSGDYYWSWIRQPPGKGLEWIGYIYYSGSTYNPSLKSRVTISVDTSKNQFSLKLSSVTAADTAVYYCARESIVGAVDYWGQGTLVTVSS | ADI-24843 | Heavy chain variable region ("HC") amino acid sequence |
| Ab 405 | 810 | DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPHTFGQGTKLEIK | ADI-24843 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 406 | 811 | EVQLVESGGGLVKPGGSLRLSCAASGFTFSSYSMNWVRQAPGKGLEWVSISSSSS YIYYADSVKGRFTISRDNAKNSLYLQMNSLRAEDTAVYYCARDYCSGGSCYLAAFDI WGQGTTVTVSS | ADI-24845 | Heavy chain variable region ("HC") amino acid sequence |
| Ab 406 | 812 | QPVLTQPASVSGSPGQSITISCTGTSSDVGGYNYVSWYQQHPGKAPKLMIYEVSNR PSGVSNRFSGSKSGNTASLTISGLQAEDEADYYCSSYTSSSTPVVFGGGTKLTVL | ADI-24845 | Light chain variable region ("LC") amino acid sequence |
| Ab 407 | 813 | EVQLLESGGGLVKPGGSLRLSCAASGFTFSSYSMNWVRQAPGKGLEWVSISSSSS YIYYADSVKGRFTISRDNAKNSLYLQMNSLRAEDTAVYYCARDDGILWLDYWGQG TLVTVSS | ADI-24846 | Heavy chain variable region ("HC") amino acid sequence |
| Ab 407 | 814 | QPGLTQPSASGTPGQRVTISCSGSSSNIGSNYVTYYQQLPGTAPKLLIYRNNQRPS GVPDRFSGSKSGTSASLAISGLRSEDEADYYCAAWDDSLSGQVFGGGTKLTVL | ADI-24846 | Light chain variable region ("LC") amino acid sequence |
| Ab 408 | 815 | EVQLVESGGGLVKPGGSLRLSCAASGFTFSSYSMNWVRQAPGKGLEWVSISSSSN YIYYADSVKGRFTISRDNAKNSLYLQMNSLRAEDTAVYYCARDRIAAYTFDYWGQG TLVTVSS | ADI-24847 | Heavy chain variable region ("HC") amino acid sequence |
| Ab 408 | 816 | QSVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLPYVFGTGTKVTVL | ADI-24847 | Light chain variable region ("LC") amino acid sequence |
| Ab 409 | 817 | EVQLVESGGGLVKPGGSLRLSCAASGFTFSSYSMNWVRQAPGKGLEWVSISSSSS YIYYADSVKGRFTISRDNAKNSLYLQMNSLRAEDTAVYYCARDTVVAGIYPDYWGQ GTLVTVSS | ADI-24848 | Heavy chain variable region ("HC") amino acid sequence |
| Ab 409 | 818 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYVFGTGTKLTVL | ADI-24848 | Light chain variable region ("LC") amino acid sequence |
| Ab 410 | 819 | QVQLVQSGGVVVQPGGSLRLSCAASGFTFSISRDNSKYSILYLQMNSLRTEDTALYYCAKDLGSSSGYFLGR DGGSTYYADSVKGRFTISRDNSKYSILYLQMNSLRTEDTALYYCAKDLGSSSGYFLGR DYYGMDVWGQGTTVTVSS | ADI-24849 | Heavy chain variable region ("HC") amino acid sequence |
| Ab 410 | 820 | DIQLTQSPSSLSASVGDRVTITCQASQDISNYLNWYQQKPGKAPKLLIYDASNLETG VPSRFSGSGSGTDFTFTISSLQPEDIATYYCQQYNNLPTFGGGTKLEIK | ADI-24849 | Light chain variable region ("LC") amino acid sequence |
| Ab 411 | 821 | QVQLVQSGGLVKPGGSLRLSCAASGFTFSSYSMNWVRQAPGKGLEWVSISSSSS SYIYYADSVKGRFTISRDNAKNSLYLQMNSLRAEDTAVYYCAREDYGDYYYYMDV WGKGTTVTVSS | ADI-24850 | Heavy chain variable region ("HC") amino acid sequence |
| Ab 411 | 822 | QPVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYVFGTGTKVTVL | ADI-24850 | Light chain variable region ("LC") amino acid sequence |
| Ab 412 | 823 | QVQLVQSGAEVKKPGASVKVSCKASGYTFTGYYMHWVRQAPGQGLEWMGWIN PNSGGTNYAQKFQGRVTMTRDTSISTAYMELSRLRSDDTAVYYCARAYELEDLDYW GQGTLVTVSS | ADI-24851 | Heavy chain variable region ("HC") amino acid sequence |
| Ab 412 | 824 | QSVLIQPPSASGSPGQSVTISCTGTSSDVGGYNYVSWYQQHPGKAPKLMIYEVSKR PSGVPDRFSGSKSGNTASLIVSGLQAEDEADYYCSSYAGSNNVTGGGTKLTVL | ADI-24851 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 413 | 825 | QVQLVESGAEVKKPGASVKVSCKASGYTFTSYAIHWVRQAPGQRLEWMGWINAG NGNTKYSQKFQGRVTITRDTSASTAYMELSSLRSEDTAVYYCASEESGYFDYWGQG TLVTVSS | ADI-24852 | Heavy chain variable region ("HC") amino acid sequence |
| Ab 413 | 826 | SYELMQPPSVPVSPGQTASITCSGDKLGDKYACWYQQKPGQSPVLVIYQDRKRPS GIPERFSGSNSGNTATLTISGTQAMDEADYYCQAWDSSTVVFGGGTKVTVL | ADI-24852 | Light chain variable region ("LC") amino acid sequence |
| Ab 414 | 827 | EVQLVESGGGLVKPGGSLRLSCAASGFTFSSYSMNWVRQAPGKGLEWVSISSSSS YIYYADSVKGRFTISRDNAKNSLYLQMNSLRAEDTAVYYCARDRRFGELFYFDYWG QGTLVTVSS | ADI-24854 | Heavy chain variable region ("HC") amino acid sequence |
| Ab 414 | 828 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGNWVFGGGTKLTVL | ADI-24854 | Light chain variable region ("LC") amino acid sequence |
| Ab 415 | 829 | EVQLVESGGGLVKPGGSLRLSCAASGFTFSSYSMNWVRQAPGKGLEWVSISSSSS YIYYADSVKGRFTISRDNAKNSLYLQMNSLRAEDTAVYYCARRYCTNGVCYDAFDI WGQGTMVTVSS | ADI-24855 | Heavy chain variable region ("HC") amino acid sequence |
| Ab 415 | 830 | QSVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSYVFGTGTKVTVL | ADI-24855 | Light chain variable region ("LC") amino acid sequence |
| Ab 416 | 831 | QVQLVQSGAEVKKPGASVKVSCKASGYTMTTDTSTAYMELRSLRSEDTAVYYCARAGIVVVPKYYYYMDVWGKGTTVTVSS | ADI-24856 | Heavy chain variable region ("HC") amino acid sequence |
| Ab 416 | 832 | DIVMTQSPGTLSLSPGERATLSCRASQSVSSSYLAWYQQKPGQAPRLLIYGASSRAT GIPDRFSGSGSGTDFTLTISRLEPEDFAVYYCQQYGSSPMYTFGQGTKVEIK | ADI-24856 | Light chain variable region ("LC") amino acid sequence |
| Ab 417 | 833 | EVQLLESGGGLVKPGGSLRLSCAASGFTFSSYSMNWVRQAPGKGLEWVSISSSSS YIYYADSVKGRFTISRDNAKNSLYLQMNSLRAEDTAVYYCAREGYYYGSGSYLDYW GQGTLVTVSS | ADI-24857 | Heavy chain variable region ("HC") amino acid sequence |
| Ab 417 | 834 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSVVFGGGTKLTVL | ADI-24857 | Light chain variable region ("LC") amino acid sequence |
| Ab 418 | 835 | EVQLLESGGGLVKPGGSLRLSCAASGFTFSSYSMNWVRQAPGKGLEWVSISSSSS YIYYADSVKGRFTISRDNAKNSLYLQMNSLRAEDTAVYYCARGGYSYGYSFDYWGQ GTLVTVSS | ADI-24858 | Heavy chain variable region ("HC") amino acid sequence |
| Ab 418 | 836 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSVVFGGGTKLTVL | ADI-24858 | Light chain variable region ("LC") amino acid sequence |
| Ab 419 | 837 | EVQLLESGGGLVKPGGSLRLSCAASGFTFSSYSMNWVRQAPGKGLEWVSISSSSS YIYYADSVKGRFTISRDNAKNSLYLQMNSLRAEDTAVYYCARDGSPINWVSPFPFDY WGQGTLVTVSS | ADI-24859 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 419 | 838 | QPVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGSVFGGGTQLTVL | ADI-24859 | Light chain variable region ("LC") amino acid sequence |
| Ab 420 | 839 | EVQLLESGGGLVKPGGSLRLSCAASGLTFSDYYMSWIRQAPGKGLEWVSYISGGSS YSNYADSVKGRFTISRDNAKNSLYLQMNSLRAEDTAVYYCARGYCSGSSCYEAFDI WGQGTTVTVSS | ADI-24860 | Heavy chain variable region ("HC") amino acid sequence |
| Ab 420 | 840 | SYVLTQPPSVSGAPGQRVTISCTGSSSNIGAGFDVHWYQQLPGTAPKLLIYGNSDRP SGVPDRRSGSKSGTSASLAITGLQAEDEADYYCQSYDSSLSGYVFGTGTKVTVL | ADI-24860 | Light chain variable region ("LC") amino acid sequence |
| Ab 421 | 841 | QVQLVQSGGGLVKPGGSLRLSCAASGFTISRDNAKNSLYLQMNSLRAEDTAVYYCAREAYAYYDSSGLKWFD SYIYYADSVKGRFTISRDNAKNSLYLQMNSLRAEDTAVYYCAREAYAYYDSSGLKWFD PWGQGTLVTVSS | ADI-24861 | Heavy chain variable region ("HC") amino acid sequence |
| Ab 421 | 842 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLGWVFGGGTKLTVL | ADI-24861 | Light chain variable region ("LC") amino acid sequence |
| Ab 422 | 843 | EVQLLESGPGLVKPSQTLSLTCTVSGGSISSGGYYWSWIRQHPGKGLEWIGYIYYSG STYYNPSLKSRVTISVDTSKNQFSLKLSSVTAADTAVYYCARLEIGDGSGSYLHWVFD LWGRGTLVTVSS | ADI-24862 | Heavy chain variable region ("HC") amino acid sequence |
| Ab 422 | 844 | SYELTQPPSVSVSPGQTASITCSGDKLGDKYACWYQQKPGQSPVLVIYQDSKRPSGI PERFSGSNSGNTATLTISGTQAMDEADYYCQAWDSSTAVFGGGTKLTVL | ADI-24863 | Light chain variable region ("LC") amino acid sequence |
| Ab 423 | 845 | EVQLLESGGGLVKPGGSLRLSCAASGFTFSSYSMNWVRQAPGKGLEWVSSISSSRS YIYYADSVKGRFTISRDNAKNSLYLQMNSLRAEDTAVYYCARVGSGSGGTVGDYWG QGTLVTVSS | ADI-24863 | Heavy chain variable region ("HC") amino acid sequence |
| Ab 423 | 846 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGWVFGGGTKLTVL | ADI-25462 | Light chain variable region ("LC") amino acid sequence |
| Ab 424 | 847 | EVQLVESGGGLVKPGGSLRLSCAASGFTFSSYSMNWVRQAPGKGLEWVSSISSSSS YIYYADSVKGRFTISRHNAKNSLYLQMNSLRAEDTAVYYCARGSSSSSWFCFDYWGQ GTLVTVSS | ADI-25462 | Heavy chain variable region ("HC") amino acid sequence |
| Ab 424 | 848 | SYVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSYVFGTGTKLTVL | ADI-25467 | Light chain variable region ("LC") amino acid sequence |
| Ab 425 | 849 | GVQLVESGPGLVKPSETLSLTCTVSGGSISSYYWSWIRQPPGKGLEWIGYIYYSGSTN YNPSLKSRVTISVDTSKNQFSLKLSSVTAADTAVYYCARGYYYDSSGYYPNDAFDIW GQGTMVTVSS | ADI-25467 | Heavy chain variable region ("HC") amino acid sequence |
| Ab 425 | 850 | DIQVTQSPSSLSASVGDRVTITCRASQSISSYLNWYQQKPGKAPKLLIYAASSLQSGV PSRFSGSGSGTDFTLTISSLQPEDFATYYCQQSYSTPYTFGQGTKVEIK | ADI-25467 | Light chain variable region ("LC") amino acid sequence |
| Ab 426 | 851 | QVQLVQSGAEVKKPGESLKISCKGSGYSFTSYWIGWVRQMPGKGLEWMGIIYPGD SDTRYSPSFQGQVTISADKSISTAYLQWSSLKASDTAMYYCARHVGQVYCSSTSCYT SREYYFDYWGQGTLVTVSS | ADI-25468 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 426 | 852 | SYVLTQPPSVSVSPGQTASITCSGDKLGDKYACWYQQKPGQSPVLVIYQDSKRPSGI PERFSGSNSGNTATLTISGTQAMDEADYYCQAWDSSTAVVFGGGTKLTVL | ADI-25468 | Light chain variable region ("LC") amino acid sequence |
| Ab 427 | 853 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARDDSSSWYYFDYWGQ GTLVTVSS | ADI-25472 | Heavy chain variable region ("HC") amino acid sequence |
| Ab 427 | 854 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYVFGIGTKVTVL | ADI-25472 | Light chain variable region ("LC") amino acid sequence |
| Ab 428 | 855 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCARLDYSNYYYMDVWG KGTTVTVSS | ADI-25478 | Heavy chain variable region ("HC") amino acid sequence |
| Ab 428 | 856 | QPVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYVFGTGTKLTVL | ADI-25478 | Light chain variable region ("LC") amino acid sequence |
| Ab 429 | 857 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARGGYSYGAYYYYMD VWGKGTTVTVSS | ADI-25479 | Heavy chain variable region ("HC") amino acid sequence |
| Ab 429 | 858 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYWVFGGGTKLTVL | ADI-25479 | Light chain variable region ("LC") amino acid sequence |
| Ab 430 | 859 | EVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARGGYSYGAYYYYMD VWGKGTTVTVSS | ADI-25480 | Heavy chain variable region ("HC") amino acid sequence |
| Ab 430 | 860 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYWVFGGGTKVTVL | ADI-25480 | Light chain variable region ("LC") amino acid sequence |
| Ab 431 | 861 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCARSIAVAGTGYGMDVW GQGTTVTVSS | ADI-25484 | Heavy chain variable region ("HC") amino acid sequence |
| Ab 431 | 862 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSVVFGGGTKLTVL | ADI-25484 | Light chain variable region ("LC") amino acid sequence |
| Ab 432 | 863 | EVQLLESGPGLVKPSQTLSLTCTVSGGSISSGGYWNSWIRQHPGKGLEWIGYIYYSG STYYNPSLKSRVTISVDTSKNQFSLKLSSVTAADTAVYYCAREVVPAAIRAGYYFDYW GQGTLVTVSS | ADI-25491 | Heavy chain variable region ("HC") amino acid sequence |
| Ab 432 | 864 | SYELMQPPSVSVSPGQTASITCSGDKLGDKYACWYQQKPGQSPVLVIYQDSKRPSG IPERFSGSNSGNTATLTISGTQAMDEADYYCQAWDSSTGGVFGTGTQLTVL | ADI-25491 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 433 | 865 | QVQLVQSGGGLVKPGGSLRLSCAASGFTFSSYSMNWVRQAPGKGLEWVSSISSSS SYIYYADSVKGRFTISRDNAKNSLYLQMNSLRAEDTAVYYCARGYCTNGVCYLDAFD IWGQGTTVTVSS | ADI-25495 | Heavy chain variable region ("HC") amino acid sequence |
| Ab 433 | 866 | QSVLIQPASVSGSPGQSITISCTGTSSDVGGYNYVSWYQQHPGKAPKLMIYDVSNR PSGVSNRFSGSKSGNTASLTISGLQAEDEADYYCCSSYTSSSTPVVFGGGTKVTVL | ADI-25495 | Light chain variable region ("LC") amino acid sequence |
| Ab 434 | 867 | QVQLVQSGGGLVKPGGSLRLSCAASGFTFSSYSMNWVRQAPGKGLEWVSSISSSS SYIYYADSVKGRFTISRDNAKNSLYLQMNSLRAEDTAVYYCARVASEVWFFDLWGR GTLVTVSS | ADI-25496 | Heavy chain variable region ("HC") amino acid sequence |
| Ab 434 | 868 | QPVLTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYVPGTGTKLTVL | ADI-25496 | Light chain variable region ("LC") amino acid sequence |
| Ab 435 | 869 | EVQLLESGGGLVQPGGSLRLSCAASGFTFSSYWMSWVRQAPGCKGLEWVANIKQD GSEKYYVDSVKGRFTISRDNAKNSLYLQMNSLRAEDTAVYYCARDGLLQYDFWSGY YDYWGQGTLVTVSS | ADI-25497 | Heavy chain variable region ("HC") amino acid sequence |
| Ab 435 | 870 | EIVLTQSPSSLSASVGDRVTITCRASQGISSMLAWYQQKPEKAPKSLIYAASSLQSGV PSRFSGSGSGTDFTLTISSLQPEDFATYYCQQYNSYPFTFGPGTKVDIK | ADI-25497 | Light chain variable region ("LC") amino acid sequence |
| Ab 436 | 871 | QVQLVQSGAEVKKPGSSVKVSCKASGGTFSSYAISWVRQAPGQGLEWMGGIIPIF GTANYAQKFQGRVTITADESTSTAYMELSSLRSEDTAVYYCARDHWSNPLYYGM DVWGQGTTVTVSS | ADI-25502 | Heavy chain variable region ("HC") amino acid sequence |
| Ab 436 | 872 | SYELTQPPSVSPGQTARITCSGDVLAKKYARWFQQKPGQAPVLVIYKDSERPSGI PERFSGSGSGTTVTLTISGAQVEDEADYYCYSAADNNLGVFGGGTQLTVL | ADI-25502 | Light chain variable region ("LC") amino acid sequence |
| Ab 437 | 873 | EVQLLESGAEVKKPGSSVKVSCKASGGTFSSYAISWVRQAPGQGLEWMGGIIPIFG TANYAQKFQGRVTITADESTSTAYMELSSLRSEDTAVYYCARSRYSGSYYYYGMDV WGQGTTVTVSS | ADI-25503 | Heavy chain variable region ("HC") amino acid sequence |
| Ab 437 | 874 | QPVLTQPPSVSPGQTASITCSGDKLGDKYACWYQQKPGQSPVLVIYQDSKRPSG IPERFSGSNSGNTATLTISGTQAMDEADYYCQAWDSSTYVFGTGTKLTVL | ADI-25503 | Light chain variable region ("LC") amino acid sequence |
| Ab 438 | 875 | EVQLVESGGGLVKPGGSLRLSCAASGFTFSSYSMNWVRQAPGKGLEWVSSISSSS YIYYADSVKGRFTISRDNAKNSLYLQMNSLRAEDTAVYYCARVVGYSGSYLDYWGQ GTLVTVSS | ADI-25505 | Heavy chain variable region ("HC") amino acid sequence |
| Ab 438 | 876 | QSVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGYVPGGGTKLTVL | ADI-25505 | Light chain variable region ("LC") amino acid sequence |
| Ab 439 | 877 | EVQLVQSGAEVKKPGSSVKVSCKASGGTFSSYAISWVRQAPGQGLEWMGGIIPIFG TANYAQKFQGRVTITADESTSTAYMELSSLRSEDTAVYYCARSRYSGSYYYYGMDV WGQGTTVTVSS | ADI-25514 | Heavy chain variable region ("HC") amino acid sequence |
| Ab 439 | 878 | SYELTQPPSVSPGQTASITCSGDKLGDKYACWYQQKPGQSPVLVIYQDSKRPSGI PERFSGSNSGNTATLTISGTQAMDEADYYCQAWDSSTYVFGIGTKLTVL | ADI-25514 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 440 | 879 | QVQLVQSGAEVKKPGASVKVSCKASGYTFTGYYMHWVRQAPGQGLEWMGWIN PNSGGTNYAQKFQGRVTMTRDTSISTAYMELSRLRSDDTAVYYCARDWAWDAFD IWGQGTMVTVSS | ADI-25517 | Heavy chain variable region ("HC") amino acid sequence |
| Ab 440 | 880 | QPGLTQPASVSGSPGQSITISCTGTSSDVGGYNYVSWYQQHPGKAPKLMIYDVSN RPSGVSNRFSGSKSGNTASLTISGLQAEDEADYYCSSYTSSSTLVFGGGTKLITVL | ADI-25517 | Light chain variable region ("LC") amino acid sequence |
| Ab 441 | 881 | EVQLVESGAEVKKPGASVKVSCKASGYTFTGYYMHWVRQAPGQGLEWMGWINP NSGGTNYAQKFQGRVTMTRDTSISTAYMELSRLRSDDTAVYYCARDWAWDAFDI WGQGTMVTVSS | ADI-25518 | Heavy chain variable region ("HC") amino acid sequence |
| Ab 441 | 882 | QSVLIQPASVSGSPGQSITISCTGTSSDVGGYNYVSWYQQHPGKAPKLMIYDVSNR PSGVSNRFSGSKSGNTASLTISGLQAEDYYCSSYTSSSTLVFGGGTQLTVL | ADI-25518 | Light chain variable region ("LC") amino acid sequence |
| Ab 442 | 883 | EVQLLESGGGLVQPGGSLRLSCAASGFTFSSYSMNWVRQAPGKGLEMVSSISSSSS YIYYADSVKGRFTISRDNAKNSLYLQMNSLRAEDTAVYYCAREWSPIVVVTNAFDIW GQGTMVTVSS | ADI-25524 | Heavy chain variable region ("HC") amino acid sequence |
| Ab 442 | 884 | QSVLTQPPSVSGAPGQRVTISCTGSSNIGAGYDVHWYQQLPGTAPKLLIYGNSNR PSGVPDRFSGSKSGTSASLAITGLQAEDEADYYCQSYDSSLSGWVFGGGTKVTVL | ADI-25524 | Light chain variable region ("LC") amino acid sequence |
| Ab 443 | 885 | QVQLVQSGGGLVKPGGSLRLSCAASGFTFSSYSMNWVRQAPGKGLEMVSSISSSS SYIYYADSVKGRFTISRDNAKNSLYLQMNSLRAEDTAVYYCARGSSSWYFDYWG QGTLVTVSS | ADI-25532 | Heavy chain variable region ("HC") amino acid sequence |
| Ab 443 | 886 | QSVVTQPPSVSGAPGQRVTISCTGSSNIGAGYDVHWYQQLPGTAPKLLIYGNSNR PSGVPDRFSGSKSGTSASLAITGLQAEDEADYYCQSYDSSLSYVFGIGTKVTVL | ADI-25532 | Light chain variable region ("LC") amino acid sequence |
| Ab 444 | 887 | QVQLVQSGAEVKKPGASVKVSCKASGYTFTGYYMHWVRQAPGQGLEWMGWIN PNSGGTNYAQKFQGRVTMTRDTSISTAYMELSRLRSDDTAVYYCARDANWGAFD IWGQGTMVTVSS | ADI-25533 | Heavy chain variable region ("HC") amino acid sequence |
| Ab 444 | 888 | QSVLIQPASVSGSPGQSITISCTGTSSDVGGYNYVSWYQQHPGKAPKLMIYDVSNR PSGVSNRFSGSKSGNTASLTISGLQAEDEADYYCSSYTSSSTWVFGGGTKLTVL | ADI-25533 | Light chain variable region ("LC") amino acid sequence |
| Ab 445 | 889 | EVQLVESGGGLVQPGGSLRLSCAASGFTFSSYAMSWVRQAPGKGLEMVSAISGSG GSTYYADSVKGRFTISRDNSKNTLYLQMNSLRAEDTAVYYCAKDYYYDSSGYPPYGI GVWGQGTTVTVSS | ADI-25542 | Heavy chain variable region ("HC") amino acid sequence |
| Ab 445 | 890 | QTVVTQEPSFSVSPGGTVTLTCGLSSGSVSTSYYPSWYQQTPGQAPRTLIYSTNTRS SGVPDRFSGSIIGNKAALTITGAQADDESDYYCVLYMGSGIMVFGGGTKVTVL | ADI-25542 | Light chain variable region ("LC") amino acid sequence |
| Ab 446 | 891 | EVQLLESGGGLIQPGGSLRLSCAASGFTFSSNYMSWVRQAPGKGLEMVSVIYSGGS TYYADSVKGRFTISRDNSKNTLYLQMNSLRAEDTAVYYCARGGIADAFDIWGQGT MVTVSS | ADI-25547 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 446 | 892 | ETTLTQSPSSVSASVGDRVTITCRASQGISWLAWYQQKPGKAPKLLIYAASSLQSGVPSRFSGSGSGTDFTLTISSLQPEDFATYYCQQANSFPRTFGQGTKLEIK | ADI-25547 | Light chain variable region ("LC") amino acid sequence |
| Ab 447 | 893 | EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARGPQFGVSYSSGWYSFDYWGQGTLVTVSS | ADI-25548 | Heavy chain variable region ("HC") amino acid sequence |
| Ab 447 | 894 | QSVLIQPRSVGSPGQSVTISCTGTSSDVGGYNYVSWYQQHPGKAPKLMIYDVSKRPSGVPDRFSGSKSGNTASLTIISGLQAEDEADYYCCSYAGSYTFVVFGGGTKLTVL | ADI-25548 | Light chain variable region ("LC") amino acid sequence |
| Ab 448 | 895 | QVQLVQSGGGLVKPGGSLRLSCAASGFTISRDNAKNSLYLQMNSLRAEDTAVYYCARVSSGWYGGGAYYFDYWGQGTLVTVSS | ADI-25549 | Heavy chain variable region ("HC") amino acid sequence |
| Ab 448 | 896 | QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALVVFGIGTKVTVL | ADI-25549 | Light chain variable region ("LC") amino acid sequence |
| Ab 449 | 897 | QVQLVQSGGGLVKPGGSLRLSCAASGFTISRDNAKNSLYLQMNSLRAEDTAVYYCARQRGIAVAGTYFDLWGRGTLVTVSS | ADI-25555 | Heavy chain variable region ("HC") amino acid sequence |
| Ab 449 | 898 | QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSTVVFGGGTKLTVL | ADI-25555 | Light chain variable region ("LC") amino acid sequence |
| Ab 450 | 899 | QVQLVQSGGGLVKPGGSLRLSCAASGFTISRDNAKNSLYLQMNSLRAEDTAVYYCARQRGIAVAGTYFDLWGRGTLVTVSS | ADI-25556 | Heavy chain variable region ("HC") amino acid sequence |
| Ab 450 | 900 | QSVLTQPPSVSGAPGQRVTISCTGSSSNIGAGYDVHWYQQLPGTAPKLLIYGNSNRPSGVPDRFSGSKSGTSASLAITGLQAEDEADYYCQSDSTVVFGGGTKVTVL | ADI-25556 | Light chain variable region ("LC") amino acid sequence |
| Ab 451 | 901 | EVQLLESGGGLVKPGGSLRLSCAASGFTFSSYSMNWVRQAPGKGLEWVSSISSSSYIYYADSVKGRFTISRDNAKNSLYLQMNSLRAEDTAVYYCARGYGSGSYLDYFDYWGQGTLVTVSS | ADI-25557 | Heavy chain variable region ("HC") amino acid sequence |
| Ab 451 | 902 | QPGLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGFYVFGTGTKLTVL | ADI-25557 | Light chain variable region ("LC") amino acid sequence |
| Ab 452 | 903 | EVQLLESGGGLVKPGGSLRLSCAASGFTFSSYSMNWVRQAPGKGLEWVSSISSSSYIYYADSVKGRFTISRDNAKNSLYLQMNSLRAEDTAVYYCARDAAAKYFDYWGQGTLVTVSS | ADI-25559 | Heavy chain variable region ("HC") amino acid sequence |
| Ab 452 | 904 | QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGKVFGTGTKLTVL | ADI-25559 | Light chain variable region ("LC") amino acid sequence |
| Ab 453 | 905 | QVQLVESGGGLVKPGGSLRLSCAASGFTSDYYMSWIRQAPGKGLEWVSYISSSSSYTNYADSVKGRFTISRDNAKNSLYLQMNSLRAEDTAVYYCARVGYSSSWYNYFDYWGQGTLVTVSS | ADI-25562 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 453 | 906 | SYVLTQPPSVSGAPGQRVTISCTGSSNIGAGYDVHWYQQLPGTAPKLLIYGNSNRPSGVPDRFSGSKSGTSASLAITGLQAEDEADYYCQSYDSSLSGPVFGGGTKLTVL | ADI-25562 | Light chain variable region ("LC") amino acid sequence |
| Ab 454 | 907 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARIRFDYGSGYAFDIWGQGTMVTVSS | ADI-25565 | Heavy chain variable region ("HC") amino acid sequence |
| Ab 454 | 908 | QPVLTQPPSVSGAPGQRVTISCTGSSNIGAGYDVHWYQQLPGTAPKLLIYGNSNRPSGVPDRFSGSKSGTSASLAITGLQAEDEADYYCQSYDSSLSGSVFGGGTKLTVL | ADI-25565 | Light chain variable region ("LC") amino acid sequence |
| Ab 455 | 909 | QVQLQWGAGLLKPSETLSLTCAVYGGSFSGYYWSWIRQPPGKGLEWIGEINHSGSTNYNPSLKSRVTISVDTSKNQFSLKLSSVTAADTAVYYCARGLPRFGVVTPNWFDPWGQGTLVTVSS | ADI-25567 | Heavy chain variable region ("HC") amino acid sequence |
| Ab 455 | 910 | EIVLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK | ADI-25567 | Light chain variable region ("LC") amino acid sequence |
| Ab 456 | 911 | EVQLLESGGGLVQPGGSLRLSCAASGFTFSSYWMHWVRQAPGKGLVWVSRINSDGSSTSYADSVKGRFTISRDNAKNTLYLQMNSLRAEDTAVYYCAREGDSSGWPGGAFDIWGQGTMVTVSS | ADI-25569 | Heavy chain variable region ("HC") amino acid sequence |
| Ab 456 | 912 | SYVLTQPPSVSVSPGQAARITCSGDALPKQYAYWYQQKPGQAPVLVIYKDSERPSGIPERFSGSSSGTTVTLTISGVQAEDEADYYCQSADSSGTFVFGTGTKLTVL | ADI-25569 | Light chain variable region ("LC") amino acid sequence |
| Ab 457 | 913 | QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDPYSSSSYYYYGMDVWGQGTTVTVSS | ADI-25572 | Heavy chain variable region ("HC") amino acid sequence |
| Ab 457 | 914 | DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLYTFGQGTKVDIK | ADI-25572 | Light chain variable region ("LC") amino acid sequence |
| Ab 458 | 915 | EVQLVESGAEVKKPGASVKVSCKASGYTFTSYYMHWVRQAPGQGLEWMGIINPSGGSTSYAQKFQGRVTMTRDTSTSTVMELSSLRSEDTAVYYCARGPYDSSGYCDYWGQGTLVTVSS | ADI-25573 | Heavy chain variable region ("HC") amino acid sequence |
| Ab 458 | 916 | SYELMQPPSVSVAPGKTARITCGGNNIGSKSVHWYQQKPGQAPVLVVYDDSDRPSGTPERFSGSNSGNTATLTISRVEAGDEADYYCQVWDSSSDQVFGGGTKVTVL | ADI-25573 | Light chain variable region ("LC") amino acid sequence |
| Ab 459 | 917 | EVQLVESGAEVKKPGASVKVSCKASGYTFTSYYMHWVRQAPGQGLEWMGIINPSGGSTSYAQKFQGRVTMTRDTSTSTVMELSSLRSEDTAVYYCARGPYDSSGYCDYWGQGTLVTVSS | ADI-25575 | Heavy chain variable region ("HC") amino acid sequence |
| Ab 459 | 918 | SYELTQPPSVSVAPGKTARITCGGNNIGSKSVHWYQQKPGQAPVLVVYDDSDRPSGIPERFSGSNSGNTATLTISRVEAGDEADYYCQVWDSSSDQVFGGGTKLTVL | ADI-25575 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 460 | 919 | EVQLVESGGGLVQPGGSLRLSCAASGFTFSSYMHWVRQAPGKGLVWVSRINSDGSSTSYADSVKGRFTISRDNAKNTLYLQMNSLRAEDTAVYYCARGLYNWNHDYWGQGTLVTVSS | ADI-25576 | Heavy chain variable region ("HC") amino acid sequence |
| Ab 460 | 920 | NFMLTQPHSVSESPGKTVTISCTRSSGSIASNYVQWYQQRPGSSPTTVIYEDNQRPSGVPDRFSGSIDSSNSASLTISGLKTEDEADYYCQSYDSSNVFGGGTKVTVL | ADI-25576 | Light chain variable region ("LC") amino acid sequence |
| Ab 461 | 921 | QVTLKESGGGLVKPGGSLRLSCAASGFTFSSYSMNWVRQAPGKGLEWVSSISSSSSYIYYADSVKGRFTISRDNKNSLYLQMNSLRAEDTAVYYCARYSSSLGAFDIWGQGTMVTVSS | ADI-25577 | Heavy chain variable region ("HC") amino acid sequence |
| Ab 461 | 922 | QSALTQPPSVSGAPGQRVTISCTGSSNIGAGYDVHWYQQLPGTAPKLLIYGNSNRPSGVPDRFSGSKSGTSASLAITGLQAEDEADYYCQSYDSSLSDVFGTGTKLTVL | ADI-25577 | Light chain variable region ("LC") amino acid sequence |
| Ab 462 | 923 | QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDSTYSEAFDIWGQGTMVTVSS | ADI-25587 | Heavy chain variable region ("HC") amino acid sequence |
| Ab 462 | 924 | QSVLIQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKVTVL | ADI-25587 | Light chain variable region ("LC") amino acid sequence |
| Ab 463 | 925 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARYSSSLGAFDIWGQGTVTVSS | ADI-25588 | Heavy chain variable region ("HC") amino acid sequence |
| Ab 463 | 926 | QSVLTQPPSVSGAPGQRVTISCTGSSNIGAGYDVHWYQQLPGTAPKLLIYGNSNRPSGVPDRFSGSKSGTSASLAITGLQAEDEADYYCQSYDSSLSDVFGTGTKVTVL | ADI-25588 | Light chain variable region ("LC") amino acid sequence |
| Ab 464 | 927 | EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARYQSSSWYYFDYWGQGTLVTVSS | ADI-25595 | Heavy chain variable region ("HC") amino acid sequence |
| Ab 464 | 928 | SYVLTQPPSVSGAPGQRVTISCTGSSNIGAGYDVHWYQQLPGTAPKLLIYGNSNRPSGVPDRFSGSKSGTSASLAITGLQAEDEADYYCQSYDSSLSGVVFGGGTKLITVL | ADI-25595 | Light chain variable region ("LC") amino acid sequence |
| Ab 465 | 929 | QVQLQESGPGLVKPSETLSLTCTVSPPSISSSSYYNGWIRQPPGKGLEWIGSIYYSGSTYYNPSLKSRVTISVDTSKNQFSLKLSSVTAADTAVYYCARPDSSGAFDIWGQGTMVTVSS | ADI-25598 | Heavy chain variable region ("HC") amino acid sequence |
| Ab 465 | 930 | SYELTQPPSVSVSPGQTARITCSADALPKQYAYWYQQKPGQAPVLVIYKDSERPSGIPERFSGSSSGTTVTLTISGVQAEDEADYYCQSADSSGTYVVFGGGTKLTVL | ADI-25598 | Light chain variable region ("LC") amino acid sequence |
| Ab 466 | 931 | EVQLVQSGAEVKKPGASVRVYCKASGYTFTTYYIHWVRQAPGQGLEWMGMINPSGGTTSYAQKFQRLTMTGDTSTSTVMELNYLRSEDTAVYYCTRDFIYFYGSGDGFDYWGQGTLVTVSS | ADI-36669 | Heavy chain variable region ("HC") amino acid sequence |
| Ab 466 | 932 | EIVMTQSPSAMSASVGDRVTITCRASQGISNYLAWFQQKPGKPVPKRLIYAASSLQSGVPSRFSGSGSGTEFTLTITSLQPEDFATYYCLQHNSYPFTFGPGTVEIK | ADI-36669 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 467 | 933 | QVQLVQSGAEVKKPGSSVKVSCKASGTFSTYTINWVRQAPGQGLEWMGRITPSLGVPLSAQKFQGRITISADKSTTTAYMELSSLGSEDTAVYYCASLNYYDTTDYYLGYSDSWGQGTLVTVSS | ADI-36670 | Heavy chain variable region ("HC") amino acid sequence |
| Ab 467 | 934 | DIVLTQTPATLSVSPGERATLSCRASHSVSNNLAWYQQKPGQAPRLLIYSASTRATGIPARFSGRGSGTEFTLTISSLQPEDFAVYYCQQYNNWPPEYTFGQGTKVDIK | ADI-36670 | Light chain variable region ("LC") amino acid sequence |
| Ab 468 | 935 | EVQLLESGGGLVKPGGSLRLSCAASGFTFSGYYMTWIRQAPEKGLEWVSYISGGSTYTNYADSVRGRFTISRDNARNSLYLQMNSLRAEDTAVYYCARDGGYGIGPLYWGQGSLVTVSS | ADI-36671 | Heavy chain variable region ("HC") amino acid sequence |
| Ab 468 | 936 | QPVLTQPPSVSGAPGQRVTISCTGSSSNIGAPFDVHWYQQLPGTAPKLIYGNSNRPSGVPDRFSGSKSGTSASLAITGLQAEDEADYYCQSYDSSLGGYVFGTGTKLTVL | ADI-36671 | Light chain variable region ("LC") amino acid sequence |
| Ab 469 | 937 | EVQLVESGGGLVKPGGSLRLSCAASGFAFNNYYMNWVRQAPGKGLEWVSSISSASTYTDYADSVKGRFTISRDNAKNSLYLHLNSLRAEDTAVYYCARDYGSGNYYNPKPLDVWGQGTTVTVSS | ADI-36672 | Heavy chain variable region ("HC") amino acid sequence |
| Ab 469 | 938 | QPVLTQPPSVSGAPGQRVTISCTGSSSNIGAGYDVHWYRQFPGTAPELLIYGNTNRPSGVPDRFSGSKSGTSASLAITGLQAEDEADYYCQSYDSSLKGVFGGGTKLTVL | ADI-36672 | Light chain variable region ("LC") amino acid sequence |
| Ab 470 | 939 | EVQLLESGGGLVKPGGSLRLSCAASGFKFRSYSMNWVRQAPGKGLEWVSSISSSSSYVDYAGSLKGRFTISRDNAENSLYLQMNSLRAEDTAMYYCARAGSVPVAGTYNDYWGQGTLVTVSS | ADI-36674 | Heavy chain variable region ("HC") amino acid sequence |
| Ab 470 | 940 | QSVLTQPPSVSGAPGQRVTISCTGSSSNIGAGYDVHWYQHLPGTAPKLLIHGNNNRPAGVPDRFSGSKSGTSASLVITGLQADDEADYYCQSYDRSLSVLFGGGTKVTVL | ADI-36674 | Light chain variable region ("LC") amino acid sequence |
| Ab 471 | 941 | QVQLVQSGGGLVQPGGSLRLCAASGFTFSSYEMNWVRQAPGKGLEWISYISSSGDTKYYADSVKGRFTVSRDNAKYSLYLQMDSLRAEDTAVYYCASLYDSRGYYWVFDYWGQGTLVTVSS | ADI-36677 | Heavy chain variable region ("HC") amino acid sequence |
| Ab 471 | 942 | DIVMTQSPSSLSASVGDRVTITCQASQDISTYLNWYQHKPGKAPNLLIYDASNLEPGVPSRFSGSGSGTDFTFTISSLQPEDIATYYCLQHDNLPPTFGQGTKVDIK | ADI-36677 | Light chain variable region ("LC") amino acid sequence |
| Ab 472 | 943 | QVQLVQSGAEVKKPGBSLKISCKGSGYSFRSYWIAWVRQMPGKGLEWMGTIFPGDSDVTYSPSFQGQVTISVDKSTSTAYLQWGSLKASDTAIYYCARRYDYIDFWGQGTLVTVSS | ADI-36679 | Heavy chain variable region ("HC") amino acid sequence |
| Ab 472 | 944 | DIQMTQSPSSLSASVGDRVTITCQASQDIINHLNWYQQKPGKAPKLLIYDASNLHPGVPSRFSGSGSGTYFTFTISSLQPDDFRATYYCQQYDFLAHITFGPGTKVDIK | ADI-36679 | Light chain variable region ("LC") amino acid sequence |
| Ab 473 | 945 | QVTLKESGAELRKPGESLKISCKASGYRFTNYWIGWVRQMPGKGLEWMGVIYPGDSDTKYSPSFQGQVTMSADKSINTAYLQWSSLKASDTAIYYCVSLFGDYDYGALDYWGQGTLVTVSS | ADI-36680 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 473 | 946 | ETTLIQSPATLSMSPGERATLSCRASQSVGRNLAWYQQKPGQAPRLLIYGASIRAT GILARFSGSGSGTEYTLTISSLQPEDFAVYYCQQYHDWPSTFGPGTKVDIK | ADI-36680 | Light chain variable region ("LC") amino acid sequence |
| Ab 474 | 947 | EVQLVESGAEVKKPGESLKISCKASGYSFTRYWIGWVRQMPGKGLEWMGIIFPGD SDTRYCPSFEGQVTISADRSINTAYLQWSSLKASDSAMYYCVTLYTDYDYGAPDHW GQGTLVTVSS | ADI-36681 | Heavy chain variable region ("HC") amino acid sequence |
| Ab 474 | 948 | DIVLTQSPATLSVSPGERATLSCRASQSLSGDLAWYQQKPGQAPRLLIYATSTRATGI PARFSGSGSGAEFTLTISSLQSEDFAVYYCQQYYDWPLLITFGPGTKVEIK | ADI-36681 | Light chain variable region ("LC") amino acid sequence |
| Ab 475 | 949 | EVQLVQSGAEVKKPGGSVKVSCKASGYTFSEYYMHWVRQAPGQGPEWVGRINPK SGRTNYAQNFQGRVTMTRDRSISTVVMDLSRLRSDDTAVYYCARWEVMDYGSGI YYNQDHFDYWGQGTLVTVSS | ADI-41144 | Heavy chain variable region ("HC") amino acid sequence |
| Ab 475 | 950 | DIRVTQSPSSLSASVGDRVTITCRASQDITNYLAWFQQKPGKAPKSLMYAASTLQSG VPSRFSGSGSGTDFTLTISSLQPEDFATYYCQQYKTYPITFGQGTRLEIK | ADI-41144 | Light chain variable region ("LC") amino acid sequence |
| Ab 476 | 951 | QVQLVQSGPGLVKPSETLSLTCTVSAGSISNFYWSWIRQPPGKGLEWIGYIYYSGST SYNPSLKSRVTISVDTSKNQFSLKLSSVTAADTAVYYCARSRSGWSLYDYWGQGTLV TVSS | ADI-41145 | Heavy chain variable region ("HC") amino acid sequence |
| Ab 476 | 952 | DIQVTQSPSSLSASVGDRVTITCRASQSISSFLNWYQQKPGKAPKLLIYVASSLQSGV PSRFSGSGSGTDFTLTISSLQPEDFATYYCQQSYNTPLTFGGGTKVDIK | ADI-41145 | Light chain variable region ("LC") amino acid sequence |
| Ab 477 | 953 | QVQLVQSGAEVKKPGESLKISCKGSGHSFAITFWIGWVRQVPGNGLEMLGIINLGD SDTKYSPSFQQGVTISADESIGTAYLQWSSLKASDTAMYYCARVSLPHYYYMDVW GKGTTVTVSS | ADI-41146 | Heavy chain variable region ("HC") amino acid sequence |
| Ab 477 | 954 | DIVMTQSPSSVSASVGDRVTITCRASQGISTWLAWYRQKPGKAPELLIYAASRLQSG VPSRFSGSGSGTDFTLTISSLQPEDFATYYCQQANSFLGAPGPGTKLEIK | ADI-41146 | Light chain variable region ("LC") amino acid sequence |
| Ab 478 | 955 | EVQLVESGGGLVKPGGSLRLSCAASGFTLSGYYMSWVRQAPGKGLEWISYISGGST YTNYADSVNGRFTISRDNAKNSLYLQMDSLRAEDTAVYYCARLEYGDYGPYYLGLW GRGTLVTVSS | ADI-41147 | Heavy chain variable region ("HC") amino acid sequence |
| Ab 478 | 956 | QSVLTQPPSVSGAPGQRVTISCTGTSSNIGAGYDVHWYQKLPGTAPKLLIYANNNR PSGVPDRFSGSKSGTSASLAITGLQAEDEADYYCQSYDTSLSAHVYFGTGTKLTVL | ADI-41147 | Light chain variable region ("LC") amino acid sequence |
| Ab 479 | 957 | QVQLVQSGGGVVQPGRSLRLSCAASGFTFSDYGMHWVRQAPGKGLEMVAVIWF DGSNKNYADSVKGRFTISRDNSMNTLYLQMNNLRAEDTAVYYCARAPYSFWSGYY LDYWGQGSLVTVSS | ADI-41149 | Heavy chain variable region ("HC") amino acid sequence |
| Ab 479 | 958 | DIVMTQSPATLSVSPGERATLSCRASQSISSNLAWYQQKSGQAPRLLIYGASTRATG IPARFSGSGSGTEFTLTISSLQSEDFAVYYCQQYSKWPQTFGQGTKVEIK | ADI-41149 | Light chain variable region ("LC") amino acid sequence |
| Ab 480 | 959 | EVQLVESGGGLVKPGGSLRLSCAASQFTFSTYDMSWVRQAPGKGLEMVASISSGS TYIYYADSVKGRFTISRDNAKHSLFLQMKSLRAEDTALYYCARQVLYDRGGYYLYFD HWGQGTLVTVSS | ADI-41153 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 480 | 960 | DIQVTQSPSSLSASVGDRVTITCRASQTIASYLNWYQQKPGKAPNLLIYAASNLQSGVPSRFSGSGSGTEFTLTINTLQPEDFATYYCQQSYNFPYTFGQGTKVEIK | ADI-41153 | Light chain variable region ("LC") amino acid sequence |
| Ab 481 | 961 | QVQLQQWGAGLSKPSETLSVTCAVYGGSLSGHYWSWFRQPPGKGLEWIGEIDHSGSTTYNPSLKSRVTISVDTSKNQFSLKLTSVTAADTAMYYCARATRYNYGYTFDYWGQGTLVTVSS | ADI-41154 | Heavy chain variable region ("HC") amino acid sequence |
| Ab 481 | 962 | DIPLTQSPSSLSASVGDRVTITCRASQIISSYLNWYQQKPGKAPKLLIYAASTLQSGVPSRFSGSRSGTDFTLTISSLQPEDFASYYCQQSYIIPFTFGPGTKVEIK | ADI-41154 | Light chain variable region ("LC") amino acid sequence |
| Ab 482 | 963 | QVQLQESGPGLVKPSETLSLTCTVSGGSIGNNFYYWGWIRQPPGKGLEWIGSIYYSGTTYDNPSLKSRVTISVEPSKNQFSLKLSSVTAADTAVYHCARRYCDSTRCYEAFDIWGQGTTVTVSS | ADI-41155 | Heavy chain variable region ("HC") amino acid sequence |
| Ab 482 | 964 | SYELTQPPSASGTPGQRVTISCSGSSSNIGSNYVSWYQQLPGTAPKLLIYNDQRPSGVPDRFSGSKSGTSASLAISGLRSEDEAEYYCAAWDDSLSGFYVFGTGTKVTVL | ADI-41155 | Light chain variable region ("LC") amino acid sequence |
| Ab 483 | 965 | QVQLVQSGGGLVQPGGSLRLSCVASGFIFSSYEMNWVRQAPGKGLEWVSYISSSGSTIYYADSVKGRFTISRDNAKNSLYLQMNSLGAEDTAVYYCARAILLYFDIWGQGTLVTVSS | ADI-41156 | Heavy chain variable region ("HC") amino acid sequence |
| Ab 483 | 966 | GIRLTQSPSSLSASVGDRVTITCRASQSITNVINWYQQKPGKAPKLLIYAISRLQSGVPSRFSGSGSGTDFTLTISSLQPEDFATYYCQQSYIMYTFGQGTKVEIK | ADI-41156 | Light chain variable region ("LC") amino acid sequence |
| Ab 484 | 967 | EVQLVESGPGLVKPSETLSLTCTVSGGSISTYYWSWIRQPPGKGLEWIGYIYYTGSTNYNPSLKSRVTISLDTSKNQFSLKLSVSAADTAFYYCARSPVPGTRSWFDPWGQGTLVTVSS | ADI-41157 | Heavy chain variable region ("HC") amino acid sequence |
| Ab 484 | 968 | SPGLTQPQSAFGTPGQRVTISCFGSSSNIGRNHIYWYQQVPGTAPKLLIYRNNQRPSGVPDRFGSKFGTSASLAISGVRSEDEADYFCAAWDDSLSGPVFGGGTKLTVL | ADI-41157 | Light chain variable region ("LC") amino acid sequence |
| Ab 485 | 969 | EVQLVESGGGLVQPGGSLRLSCAASGTFSSYNIAWVRQAPGKGLEWISYISSSSSVIYYADSVKGRFTISRDNAKNSLYLQMNSLRDEDTAMYYCARAGNDYNFWSGRSSEYFDYWGQGTLVTVSS | ADI-41158 | Heavy chain variable region ("HC") amino acid sequence |
| Ab 485 | 970 | DIVMTQSPATLSVSPGERATLSCRASQSVSSNLAWYQQKPGQAPRLLIYGASTRATGIPARFSGSGSGTEFTLTISSLQSEDFAVYYCQQYDNWPLYTFGQGTKLEIK | ADI-41158 | Light chain variable region ("LC") amino acid sequence |
| Ab 486 | 971 | EVQLVESGAEVKKPGESLKISCKGSGYSFTTYWIGHVRQMPGKGLEWMGIMYPGDSQTRYSPSFQGQVTISADKSISTAYLQWSSLKASDTAMYYCARGGYCSGGSCYRGLDYWGQGTLVTVSS | ADI-41159 | Heavy chain variable region ("HC") amino acid sequence |
| Ab 486 | 972 | EIVMTQSPSSLSASVGDRVTITCRASQSISSFLNWYQQKPGKAPNLLIYAASSLLSGVPSRFSGSGSGTDFTLTISSLQPEDFATYYCQQSHSTPQTFGQGTKLEIK | ADI-41159 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 487 | 973 | QVQLVQSGAEVKKPGSSVKVSCKASGTFSSYPIIWVRQAPGQGLEWMGRIIPILGI ASYAQKFQGRVTITADKSTSTAYMELSSLRSEDTAVYYCARNSDFYGMDVWGQG TTVTVSS | ADI-41160 | Heavy chain variable region ("HC") amino acid sequence |
| Ab 487 | 974 | QSALIQPASVSGSPGQSITISCTGTSSDVGGYNYVSWYQHPGKAPKLMIYDVSNR PSGISNRFSGSKSGNTASLTISGLQAEDEADYYCCSYTSSSLYVFGTGTKVTVL | ADI-41160 | Light chain variable region ("LC") amino acid sequence |
| Ab 488 | 975 | EVQLVESGGGLVQPGGSLRLSCAASGFTFSTFEFNWVRQAPGKGLEWLSYISSDDT TRYYADSVKGRFTISRDNAKNSLYLQMNSLRAEDTAYYYCVRGGPYDYVWGTYRYF DFWGQGTLVTVSS | ADI-41161 | Heavy chain variable region ("HC") amino acid sequence |
| Ab 488 | 976 | QSVLTQPASVSGSPGQSITISCTGTSSDIGGYNYVSWYQQHPGKAPKLMIYDVTNR PLGVSNRFSGSKSGNTASLIISGLQAEDEAEYYCCSYTSSNSLVFGGGTKLTVL | ADI-41161 | Light chain variable region ("LC") amino acid sequence |
| Ab 489 | 977 | EVQLVQSGAEVKKPGSSVKVSCKASGGVTGTFSSYAISWVRQAPGQGLEWMGGI MPMFGTTNYAQKFQGRVTITADKSTSTAYMELSSLRSEDTAVYYCARDYRDFSPHL DYYYMDVWGKGTTVTVSS | ADI-41162 | Heavy chain variable region ("HC") amino acid sequence |
| Ab 489 | 978 | DIRLTQSPGTLSLSPGERATLSCRASQSVSTSYLAWYQQKPGQAPRLLIYGASNRAT GIPDRFSGSGSGTDFTLTISRLEPEDFAVYYCQQYGRTSWTFGQGTKVDIK | ADI-41162 | Light chain variable region ("LC") amino acid sequence |
| Ab 490 | 979 | QVQLVQSGGGVVQPGRSLRLSCAASGFPFHSYAMHWVRQAPGKGLEWVAVIWY EGSEKHYADSVQGRFTISRDNSKNMLYLQMNNLRVADTAVYYCARRGAWGPDIW GQGTTVTVSS | ADI-41163 | Heavy chain variable region ("HC") amino acid sequence |
| Ab 490 | 980 | DIVMTQTPLSLPVTPGEPASISCRSSQSVLHSTGYNSLDWYLQKPGQSPQLLIFLGSN RASGVPDRFSGSGSGTDFTLKISRVEAEDVGVYYCMQGLQTPYTFGQGTKVEIK | ADI-41163 | Light chain variable region ("LC") amino acid sequence |
| Ab 491 | 981 | QVQLVQSGGDLVQPGGSLRLSCAASGFTFSDYEVNWVRQAPGKGLEWLSYISSSG RIIHYADSVRGRFTISRDNAKNSLYLQMNSLRAEDTAVYYCARAAGQWLVTYYYG MDVWGQGTTVTVSS | ADI-41164 | Heavy chain variable region ("HC") amino acid sequence |
| Ab 491 | 982 | QSVMTQSPSTLSASVGDTVTITCRASQSIINRLAWYQQKPGKPPKLLIYKSSSSESGV PSKFSGSGSGTEFTLTINSLQPDDFATYYCQHYNSYLYTFGQGTKVEIK | ADI-41164 | Light chain variable region ("LC") amino acid sequence |
| Ab 492 | 983 | EVQLVETGAEVKKPGESLKISCKGSGYSFTSYWIGWVRQMPGKGLEWMGIIYPGD SDTRYSPSFQQVTISADKSISTAYLQWSSLKASDTAMYYCARRYDYIDIWGQGTM VTVSS | ADI-41165 | Heavy chain variable region ("HC") amino acid sequence |
| Ab 492 | 984 | DIRVTQSPSSLSASVGDRVTITCQASQDISNVLNWYQQKPGKAPKLLIYDASNLETG VPSRFSGSGSGTDFTFTISSLQPEDIATYYCQQYDNLAHITFGPGTKVEIK | ADI-41165 | Light chain variable region ("LC") amino acid sequence |
| Ab 493 | 985 | EVQLVQSGAEVKKPGASVKVSCKTSGYTFTGDYLHWVRQAPGQGLEWMGRLNP KSGGTVYAQRFQGRVTMTGDTSVTTAYMQLTRLRSDDTAIYYCARGIPVSGPVSID YWGQGTLVTVSS | ADI-41166 | Heavy chain variable region ("HC") amino acid sequence |
| Ab 493 | 986 | QSVLTQPASLSGSPGQSITISCTGTSSDVGGYGVSWYQQHPGKAPKLMIYDVANR PSGVSHRFSGSKSGNTASLTIIGLQADDEADYYCCSSYTRSNTVVFGGGTKLTVL | ADI-41166 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 494 | 987 | EVQLVETGGGVVQPGRSLRLSCAASGFTFSSYGMHWVRQAPGKGLEWVAVISYD GSNKYYADSVKGRFTISRDNSKNTLYLQMNSLRTEDTAVYYCAKGGGGYYYYMDV WGKGTTVTVSS | ADI-41168 | Heavy chain variable region ("HC") amino acid sequence |
| Ab 494 | 988 | QPVLTQPASVSGSPGQSITISCTGTSSDVGGYNYVSWYQQHPGKAPKLMIYGVNN RPSGVSNRFSGSKSGNTASLTISGLQGEDEADYYCNSYRSGITVVFGGGTKLTVL | ADI-41168 | Light chain variable region ("LC") amino acid sequence |
| Ab 495 | 989 | EVQLVESGAEVKKPGESLKISCEAFGSFTSYWIGWVRQVPGRGLEWIGVIYPGDSD IRYTPSFRGQVTISADRSISTAYLQWNNLKASDTAMYYCARPGRDINYYHSRDYGAL DIWGQGTTVTVSS | ADI-41169 | Heavy chain variable region ("HC") amino acid sequence |
| Ab 495 | 990 | DIQLTQSPDSLAVSLGERVTINCKSSQSFLYSSNNKNYLAWYQQKPGQPPKLLIYWA SVRESGVPDRFSGSGSGTDFTLTISSLQAEDVAVYYCQEYYSPPMTFGQGTKVEIK | ADI-41169 | Light chain variable region ("LC") amino acid sequence |
| Ab 496 | 991 | EVQLLESGGGLIQPGGSLRLSCAASGFTFNNYVMSWVRQAPGKGLEWVAAISSSG VSTYYAASVKGRFTISRDNSKNMLYVQLNSLRAEDTAVYYCAKETGSYYFDSWGQ GTLVTVSS | ADI-41170 | Heavy chain variable region ("HC") amino acid sequence |
| Ab 496 | 992 | ETTLTQSPSTLSGSVGDRVTITCRASESISSWLAWYQQKPGKAPKLLIYKASNLESGV PSRFSGSGSGTEFTLTISSLQPDDFATYYCQQYNSYLITFGQGTRLEIK | ADI-41170 | Light chain variable region ("LC") amino acid sequence |
| Ab 497 | 993 | EVQLVESGPGLVKPSQTLSLTCTVSGGSISSGGDYWSWVRQRPGKGLEWIGYIYNS GSGYNPSLKNRVSMSMHTSRNQFSLRLSSVTAADTAFYYCARDPFYRSGGIHYFD YWGQGALVTVSS | ADI-41171 | Heavy chain variable region ("HC") amino acid sequence |
| Ab 497 | 994 | DIVLTQTPGTLSLSPGEGATLSCRASPSVGSTSLAWYQQKPGQAPRLLIYGASSRAT GIPDRFSGSGSGTDFTLTISRLEPEDFAVYYCQQDGGLPITFGLGTRLEIK | ADI-41171 | Light chain variable region ("LC") amino acid sequence |
| Ab 498 | 995 | EVQLLESGGGLVQPGGSLRLSCASGFTFSVYAMHWVRLAPGKGLEYVSTISGNGG STYYGDSVKGRFTSRDNSKNTVYLQMSSLRAEDTAVYYCVKAPARDHYEILTLLGY FDYWGQGTLVTVSS | ADI-41172 | Heavy chain variable region ("HC") amino acid sequence |
| Ab 498 | 996 | DIVMTQSPDSLAVSLGERATINCKSSQSVLYSSNNKNYLAWYQQKPGQPPKLLIYW ASTRESGVPDRFSGSGSGTDFTLTISSLQAEDVAVYYCQQYYTIPPMTFGQGTKVEI K | ADI-41172 | Light chain variable region ("LC") amino acid sequence |
| Ab 499 | 997 | QVQLVQSGAEMKKPGSSAKVSCKASGGTLSSYAINWVRQAPGQGLEWMGGIIPIF GTTKYAPKFQDRVTITVDESTSTAYMELSSLRSEDTAVYYCSRESSTWDVAHYFDYW GQGTLVTVSS | ADI-41173 | Heavy chain variable region ("HC") amino acid sequence |
| Ab 499 | 998 | DIVMTQTPSAISASVGDRVTITCRASQGISNLAWYQQKPGKVPKRLIYGASSLQSG VPSRFSGSGSGTEFTLTISSLQPEDFATYYCLQHNSYPYTFGQGTKVEIK | ADI-41173 | Light chain variable region ("LC") amino acid sequence |
| Ab 500 | 999 | EVQLVESGAEVEKPGASVKVSCKASGYTFINYDIIWVRQAPGQGLEWMGWISGYK GNTNYAQKLQGRITMSTDTSTRTAYMELRSLLTSDDTAVYYCARVGGTARSTTPYYY GMDVWGQGTTVTVSS | ADI-41174 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 500 | 1000 | SYVLTQPPSVSVSPGQTARITCSGDAVPKQFSYWYQQKPGQAPVLVIYKDIERPSGIPERFSGSGSGTTVTLTISGVQAEDEADYYCQSAHTSGTYHVFGTGTKLTVL | ADI-41174 | Light chain variable region ("LC") amino acid sequence |
| Ab 501 | 1001 | EVQLLESGGGVVQPGRSLRLSCATSGFTFSSYGMHWVRQAPGKGLEWVAVIYYEGSNKYYGDSVKGRFTISRDNSKSTLYLQMNRLRAEDTAVYYCARRPAGGFDYWGPGTLVTVSS | ADI-41175 | Heavy chain variable region ("HC") amino acid sequence |
| Ab 501 | 1002 | EIVMTQSPLSLPVTPGEPASISCRSSQNLLNSNGYNYLDWYLQKPGQSPQLLIYLGSNRASGVPDRFSGSGSGTDFTLKISRVEAEDVGVYYCMQALQTPYTFGQGTKLEIK | ADI-41175 | Light chain variable region ("LC") amino acid sequence |
| Ab 502 | 1003 | EVQLVESGPGLVKPSETLSLTCTVSGGSIGNDYYWGWIRQPPGKGLEWIGNISYSGSTYYNPSLKSRVTISVGTSKNQFSLKLTSVSAADTAVYHCVGRTFWRDCSSTSCYEYYFDYWGQGTLVTVSS | ADI-41176 | Heavy chain variable region ("HC") amino acid sequence |
| Ab 502 | 1004 | ETTLIQSPTSLSASVGDRVTITCRASQGISNYLAWYQQKPGKVPKVLIYAASTLQSGVSSRFSGSGSGTGFTLTISNLQPEDVATYYCQNYNSAPWTFGQGTKVEIK | ADI-41176 | Light chain variable region ("LC") amino acid sequence |
| Ab 503 | 1005 | QVQLVQSGAEVKKPGASVKVSCKASGYMFTGYYMHWVRQAPGQGLEWMGRINPNSGGTNYAQKFQGRVTMTRDTSISTGYMELSRLRSDDTAVVFCARDFFPLVIPTLIVGRGLYDMDVWGQGTMVTVSS | ADI-41177 | Heavy chain variable region ("HC") amino acid sequence |
| Ab 503 | 1006 | QPGLTQPPSASGTPGQRVTISCSGRSSNIGSNTVNWYQQLQGTAPKLLIYKNNQRPSGVPDRFSGSKSGTSASLAISLQSEDEADYYCAAWDDSLNGVVFGGGTKVTVL | ADI-41177 | Light chain variable region ("LC") amino acid sequence |
| Ab 504 | 1007 | QVQLVESGAEVKKPGASVKVSCKASGYTFTDYYMHWVRQAPGQGLEWMGRINPNSGGTNYAQKFQGRVTMTRDTISTAYMELSSLRSDDTAVYYCARDLTAGGYGSTWYSCGDYWGQGTLVTVSS | ADI-41178 | Heavy chain variable region ("HC") amino acid sequence |
| Ab 504 | 1008 | EIVLTQSPATLSVSPGERATLSCRASQSVSSNLAWYQQKPGQAPRLLIYGASTRATGIPARFSGSGSGTEFTLTISSLQSEDFAVYYCQQYNNWPRWTFGQGTKVEIK | ADI-41178 | Light chain variable region ("LC") amino acid sequence |
| Ab 505 | 1009 | QVQLVQSGAEVKKPGSSVKISCKASGGTFSSHPISWVRQAPGQGLEWMGRIVPIFGIANYAQKFQGRVTMIADKSTNTAYMELSNLRSEDTAVYYCANPVVDSSGFQWGQGTLVTVSS | ADI-41179 | Heavy chain variable region ("HC") amino acid sequence |
| Ab 505 | 1010 | QPVLTQPRSVSGSPGQSVTISCTGTSGDGGFYNYVSWYQQHPGKTPKLMIYDVDQRPSGVPDRFSGSKSGNTASLTISGLQAEDEADYYCCSYPGNPLYVFGTGTKVTVL | ADI-41179 | Light chain variable region ("LC") amino acid sequence |
| Ab 506 | 1011 | EVQLVQSGGGLVKPGGSLRLSCAASGFTFIDYYMSWIRQAPGKGLEWVSSISGGSTYTTYADSVKGRFTISRDNGKNSLYLQMDSLRAEDTAVYYCARLGGYSYMDVWGKGTTVTVSS | ADI-41180 | Heavy chain variable region ("HC") amino acid sequence |
| Ab 506 | 1012 | QPVLTQPPSVSGAPGQRVTISCTGSSSNIGAGYDVHWYQHLPGAAPKLLIYDNTNRPSGIPDRFSGSKSGTSASLAITGLQAEDEADYYCQSYDSSLDWVFGGGTKVTVL | ADI-41180 | Light chain variable region ("LC") amino acid sequence |
| Ab 507 | 1013 | QVQLVQSGAEVKKPGSSVKVSCKASGGSFSSYTLNWVRQAPGQGLEWMGRFVPIVGIANYAQKFQGRVTITADKSTSTVMELSSLRSEDTAVYYCATAPTAYCSGDCYSLFDPWGQGTLVTVSS | ADI-41181 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 507 | 1014 | QSVLIQPASVSGSPGQSITISCTGISSDVGSYNLVSWYQQHPGKAPKLIIYEVNKRPS GVSNRFSGSKSGNTASLTISGLQAEDEADYYCCSYAVSRTSLYVFGTGTKVTVL | ADI-41181 | Light chain variable region ("LC") amino acid sequence |
| Ab 508 | 1015 | QVQLVQSGAEVKKPGESLKISCQGSGYSFTSYWIGWVRQMPGKDLEWMGIIYPSD SDTRYSPSFQGQVTISVDKSINTAYLQWTSLKASDTAMYYCARCDGAVYWYFDLW GRGTLVTVSS | ADI-41182 | Heavy chain variable region ("HC") amino acid sequence |
| Ab 508 | 1016 | EIVLTQSPATLSVSPGERVTLSCRASRSVSSHLAWYQQKPGQAPRLLMYGASTRAT GIPARFSGSGSGTEFTLTISSLQSEDFGVYYCQQYNNWPPALTFGGGTKLEIK | ADI-41182 | Light chain variable region ("LC") amino acid sequence |
| Ab 509 | 1017 | QVQLQESGAGLVKPSETLSLTCGVYGESFSGHSWSWIRQPPGRGLEWIGEINQSGT TKYNPSLRSRVTISVDRSKNEFSLKVSSVTAADTAVYFCARYFRSFYTIGPDYYMDV WGKGTTVTVSS | ADI-41183 | Heavy chain variable region ("HC") amino acid sequence |
| Ab 509 | 1018 | EIVLTQSPSSLSASVGDRVTITCRASQNINNYLNWYQQKPGKAPRLLIYAASSLQSGV PSRFTGSGSGTDFTLTIRSLQSEDFATYYCQHSYSSSLLITPGGGTKVDIK | ADI-41183 | Light chain variable region ("LC") amino acid sequence |
| Ab 510 | 1019 | EVQLLETGSGGLVQPGGSLRLSCAASGFTFSSYDMNWVRQAPGKGLEMVSTISGSG GPTYYAGSVKGRFTISRDNSKNTLYLQMNSLRADDTAVYYCAKAQLYDTSGYYLYF DYWGQGTLVTVSS | ADI-41184 | Heavy chain variable region ("HC") amino acid sequence |
| Ab 510 | 1020 | DIRMTQSPSSLSASVGDRVTITCRASQRITSYLNWYQQKPGKAPKLLIYAASSLQSGV PSRFSGSGSGTDFTLTISSLQPEDFATYFCCQSYSTSFTFGPGTKVDIK | ADI-41184 | Light chain variable region ("LC") amino acid sequence |
| Ab 511 | 1021 | QVQLQQWGAGLLKPSETLSLTCAVYGGSFSSYYYSWIRQPPGKGLEWIGEINQSGS TNYNPSLKSRVTISVDTSKNEFSLKLSSVTAADTAVYYCARIVREFNTRWYDYYMD VWGKGTTVTVSS | ADI-41185 | Heavy chain variable region ("HC") amino acid sequence |
| Ab 511 | 1022 | DIRVTQSPATLSLSPGERATLSCRTSQSISSSYLAWYQQKPGQAPRLLIYGASSRATGI PDRFSGSGSGTDFTLTISRLEPEDFAVYYCQQYGISPPMYTFGQGTKVEIK | ADI-41185 | Light chain variable region ("LC") amino acid sequence |
| Ab 512 | 1023 | EVQLLESGAEVKKPGESLKISCKGSGYSFSSYWIAWVRQMPGKGLEWMGIIYPSDS DTKYSPSFQGQVTISADKSISTAYLQWSSLKASDTAMYYCARQAGIQRPLDYWGQ GTLVTVSS | ADI-41186 | Heavy chain variable region ("HC") amino acid sequence |
| Ab 512 | 1024 | EIVMTQSPATLSVSPGERATLSCRASQSVRSNLAWYQQKPGQAPRLLIYDASTRAT GISARFSGSGSGTEFTLTISSLQSEDFRAVYYCQQFHNWPPYTFGQGTKVEIK | ADI-41186 | Light chain variable region ("LC") amino acid sequence |
| Ab 513 | 1025 | QVQLQQWGAGLLKSSETLSLTCAVYGGSFSGYYWSWIRQSPGKGLEWIGEINHSG SANYNPSLKNRVTISRDTSKNQFSLWLSSVTAADTAVYYCARTSRSPEPDNYYYM DVWGRGTTVTVSS | ADI-41188 | Heavy chain variable region ("HC") amino acid sequence |
| Ab 513 | 1026 | QSVLTQPPSVSGAPGQRVSISCTGSSSDIGAGYDVHWYQQFPGTAPKLLMYANNN RPSGVPDRFSGSRSGTSASLAITGLQAEDEADYYCQSYDSNLDVVFGGGTKLITVL | ADI-41188 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 514 | 1027 | QVQLVESGGGLVKPGGSLRLSCAASGTFSSYSMNWVRQAPGKGLEWVSMSSS SGYIDYADSVKGRFTISRDNAKNSLYLQMNSLRVEDTAVYYCARRNAVVVPSLMVV ADYYYGMDVWGQGTTVTVSS | ADI-41189 | Heavy chain variable region ("HC") amino acid sequence |
| Ab 514 | 1028 | QSVLTQPPSVSGAPGQRVTISCTGSSSNIGAGYDVHWYQQLPGTAPKLLIYGNSNR PSGVPDRFSGSKSGTSASLAITGLQAEDEADYYCQSYDTSLSGPGYVFGTGTKLTVL | ADI-41189 | Light chain variable region ("LC") amino acid sequence |
| Ab 515 | 1029 | QVQLVQSGAEVKKPGASVKVSCKAFGYTFRSYDMQWVRQAPGQRLEMMGWIN AVNGDTIKYSQKFQGRVTITRDTSATTVYMELSSLRSEDTAVYYCARMGRFWNSRS LDYYAMDVWGQGTTVTVSS | ADI-41190 | Heavy chain variable region ("HC") amino acid sequence |
| Ab 515 | 1030 | DIVMTQSPGTLSLSPGERATLSCRASQSISSSYLVWYQHKPGQAPRLLIYGASTRATD IPDRFSGSGSGTDFTLTISRLEPEDFAVYYCQQYGSSPLITFGQGTRLEIK | ADI-41190 | Light chain variable region ("LC") amino acid sequence |
| Ab 516 | 1031 | QVQLVQSGAEVKRPGASVKVSCKASGYIFSHYGISWVRQAPGQGLEMMAWISAY NGNTNYAQKLQGRVIVTIDTSTSTAYMELRSLRSDDTAVYYCAREPPSLSAAATLD YWGQGTLVTVSS | ADI-41191 | Heavy chain variable region ("HC") amino acid sequence |
| Ab 516 | 1032 | EIVLTQSPLSLPVTLGQPASISCRSNQSLVVSDGNIYLSWFQQRPGQSPRRLIYKVSN RDSGVPDRFSGSGSGTDFTLKISRVEAEDVAVYYCMQVTHWPHEFGQGTKLEIK | ADI-41191 | Light chain variable region ("LC") amino acid sequence |
| Ab 517 | 1033 | QVQLVQSGAEVKKPGASVKVSCRTSGYTFTDYEINWVRQAPGQGLEMMGGISAY NGKTDYAQNLQDRVTMTDTSTSTAYMELRSDDTAVYYCARIFPYDRSGYYLA LFDSWGHGTLVTVSS | ADI-41192 | Heavy chain variable region ("HC") amino acid sequence |
| Ab 517 | 1034 | DIQMTQSPSSLSASVGDRVTITCRASQRIASYLNWYQQKPGKAPKLLIYAASSLQSG VPSRFSGSGSGTDFTLTISSLQPEDFATYYCQQSYSTPTLTFGGGTKMDIK | ADI-41192 | Light chain variable region ("LC") amino acid sequence |
| Ab 518 | 1035 | EVQLVESGGGLVKPGMSLRLSCAASGFRFSDHYMNWIRQAPGKGLEWVSYISSSS TYTDYTDSVKGRFTISRDNSKNSVYLQMNSLRAEDTAIYYCARVAPIRHNGDYIDYW GQGTTVTVSS | ADI-41193 | Heavy chain variable region ("HC") amino acid sequence |
| Ab 518 | 1036 | NFMLTQPPSASGTPGQRVTISCTGSSSNIGAGYDVHZYQQIPGTAPKWYGNNNRP SGVPDRFSGSKSGTSASLAITGLQTEDEADYYCQSYDRGLSGRVFGTGTKVTVL | ADI-41193 | Light chain variable region ("LC") amino acid sequence |
| Ab 519 | 1037 | QVQLQESGPGLVKPSQMLSLITCTVSGDSISSGDYYNSWIRHHPGKGLEWIGYISYS GSTYNNPSLKSRVTVSVDTSKNQFFLKLTSVTAADTAVYYCARATKPYHSYFYMDV WGKGTTVTVSS | ADI-41194 | Heavy chain variable region ("HC") amino acid sequence |
| Ab 519 | 1038 | EIVLTQSPGTLSLSPGERATLSCRASQSGSRSYLAWVQQRPGQAPRLLIYGASNRAT GIPDRFSGSGSGTDFTLTISRLEPEDFAVYYCQQYGNAPITFGGGTKVDIK | ADI-41194 | Light chain variable region ("LC") amino acid sequence |
| Ab 520 | 1039 | EVQLVESGGGLVQPGGSLRLSCAASGFTISRDNSKKTLYLQMNSLRAEDTAVYYCARTESNTLAPSWSGR YVTDWYFDLWGRGTLVTVSS | ADI-41196 | Heavy chain variable region ("HC") amino acid sequence |
| Ab 520 | 1040 | EIVMTQSPSSLSASVGDRVTITCRASQSISSFLNWYQQKPGKAPKLLISAASSLQSGV PSRFSGSGSGTDFTLTISSLQPEDFATYYCQQSYSIPTFGQGTRLEIK | ADI-41196 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 521 | 1041 | QVQLVQSGAEVKKPGASVKVSCKASGYTFSGYYMHWVRQAPGQGLEMWVRGRINPKSGDTVYAQKFQGRVTMTRDTSISTAYMELSRLISDDTAKYYCARQEDHYYGSGNFYNSFDFWGQGTLVTVSS | ADI-41197 | Heavy chain variable region ("HC") amino acid sequence |
| Ab 521 | 1042 | ETTLTQSPSSLSASVGDRVTITCRASQSISSNLNWYQQKPGKAPKLLIYGASTLQSGVPSRFSGSGSGTDFTLTISSLQPEDLATYYCQQSYSNPGKITFGQGTKVDIK | ADI-41197 | Light chain variable region ("LC") amino acid sequence |
| Ab 522 | 1043 | EVQLVQSGGVVIQPGGSLRLSCAASGFSFDEYLMHWVRQLPGKGLEMWVALLISWHGDITYYADSVKGRFTISRDNSRYSLYLQMNSLRSDDTALYYCVKDGWIEGAFNHTFGIGYYFENWGQGTLVTVSS | ADI-41198 | Heavy chain variable region ("HC") amino acid sequence |
| Ab 522 | 1044 | DIVLTQTPSSLSASVGDRVTITCQASQDINNCLNWYQQKPGKAPEVLIFDASNLETGVPLRFSGSGSGTHFTLTISSLQPEDIATYYCQQHENVPLITFGGGTKVEIK | ADI-41198 | Light chain variable region ("LC") amino acid sequence |
| Ab 523 | 1045 | QVQLVESGGGLVKPGGSLRLSCGASGFTFPDYYMSWIRQAPGKGLEWLSYISSSSSFTDYADSVKGRFTISRDNAKKSLYLQMNSLRAEDTAVYYCARVRADYVGNSRIHFDYWGQGTLVTVSS | ADI-41199 | Heavy chain variable region ("HC") amino acid sequence |
| Ab 523 | 1046 | DIVMTQSPVTLSVSPGERATLSCRASQSLNGYLAWYQQKPGQAPRLLIYGASTRATEPGWDTSGRGSGTEFFTLTISSLQSEDFAVYYCQQYNDWPFTFGQGTRLEIK | ADI-41199 | Light chain variable region ("LC") amino acid sequence |
| Ab 524 | 1047 | EVQLLESGGGLVKPGGSLRLSCAASGLTFSDHDMSWVRQAPGKGLEMVSGIGGSGSNTYYAGSVKGRFTISRDNSKNTLYLQMDSLRVEDTAVYYCAKDPYGDYRDYYGMDVWGQGTTVTVSS | ADI-41200 | Heavy chain variable region ("HC") amino acid sequence |
| Ab 524 | 1048 | DIVLTQTPFSLPVTPGEPASISCRSSQSLLKSNGYNYLDWFLQKPGQSPQLLIYLGSNRASGVPDRFSGSGSGTDFTLKISRVEAEDVGVYYCMQTLQALYTFGQGTKVEIK | ADI-41200 | Light chain variable region ("LC") amino acid sequence |
| Ab 525 | 1049 | EVQLLESGGGLVQPGGSLRLSCAASGFAFDIYSMNWVRQAPGKGLEMLSYISSRGETIYYADSVKGRFTISRDNARNSLYLQMNGLREDTATYYCYYYGSGISSHGGAFDYWGQGTLVTVSS | ADI-41201 | Heavy chain variable region ("HC") amino acid sequence |
| Ab 525 | 1050 | DIVMTQTPATLSLSPGERATLTSRASQSVSSFLAWYQQKPGQAPRLLIYDVSNRAITGVPARFSGSGSGTDFTLTISSLEPEDIAVYYCQQRNTWPAITFGQGTKVEIK | ADI-41201 | Light chain variable region ("LC") amino acid sequence |
| Ab 526 | 1051 | QVQLVESGAEVKKPGSSVKISCKASGGTFSSHPISWVRQAPGQGLEMMGRIVPIFGIANYAQKFQGRVTMIADKSTNTAYMELSNLRSEDTAVYYCASPVYDSSGFQWGQGTLVTVSS | ADI-41202 | Heavy chain variable region ("HC") amino acid sequence |
| Ab 526 | 1052 | QSALIQPRSVSGSPGQSVTISCTGTSGDGGFYNYVSWYQQHPGKTPKLMIYDVDQRPSGVPDRFSGSKSGNTASLTISGLQAEDEADYYCCSYPGNPLYVFGTGTKLTVL | ADI-41202 | Light chain variable region ("LC") amino acid sequence |
| Ab 527 | 1053 | QVQLVQSGAEVRKPGESLKISCKASGYRFTNYWIGWVRQMPGKGLEMMGVIYPGDSDTRYSPSFQGQVTMSADKSTNTAYLQWSSLKASDTAIYYCVSLYSDYDYGALDYWGQGTLVTVSS | ADI-41203 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 527 | 1054 | EIVMTQSPATLSVSPGERATLSCRASENVGRNLAWYQQKPGQAPRLLIYGASIRAT GILARFSGSGSGTEYTLTISSLQSEDFAVYYCQQYHDWPSTFGPGTKVDIK | ADI-41203 | Light chain variable region ("LC") amino acid sequence |
| Ab 528 | 1055 | EVQLLESGGGLVKPGGSLRLSCAASGFTFSSYSMNWVRQAPGKGLEWVSSISAGSS YIYYADSVKGRFTISRDNAKNSLYLQMNSLRAEDTAVYYCARVPSYETTPYFDYWG QGTLVTVSS | ADI-41204 | Heavy chain variable region ("HC") amino acid sequence |
| Ab 528 | 1056 | QSVLTQPPSVSGAPGQRVTISCTGSSNIGSGYDLHWYQQLPGTAPKLLIYVNSNRP SGVPDRFSGSKSGTSASLAITGLQAEDEADYYCQSYDSSLSGYVFGTGTKVTVL | ADI-41204 | Light chain variable region ("LC") amino acid sequence |
| Ab 529 | 1057 | QVQLQESGPGLVKPSGTLSLTCAVSGGSISSTNWWSWVRQPPGKGLEWIGEIYHS GSTNYNPSLKSRVTISVDKSNNQFSLNLSSVTAADTAVYYCARGVITYRGSWFLQYF DYWGQGTLVTVSS | ADI-41205 | Heavy chain variable region ("HC") amino acid sequence |
| Ab 529 | 1058 | DIRVTQSPDSLAVSLGERATINCKSSQSLFYSSNNQNYLAWYQQKPGQPPKLLIYW ASTRQSGVPHRFSGSGSGTDFTLTISSLQAEDVAVYYCQQYYSSPLTFGGGTKVEIK | ADI-41205 | Light chain variable region ("LC") amino acid sequence |
| Ab 530 | 1059 | EVQLLESGGGLVKPGGSLRLSCAGSGFSFSSYSMNWVRQAPEKGLEWVSSISASSSF INYADSVKGRFIISRDNAKNSLFLQMDSLRAEDTAVYYCARDGVHPGGYIFGGYIDS WGQGTLVTVSS | ADI-41206 | Heavy chain variable region ("HC") amino acid sequence |
| Ab 530 | 1060 | QSVLTQPPSVSGAPGQRVTISCTGSSNIGAGYDVHWFRQLPGTAPKLLIYGNNNR PSGVPDRFSGSGSSASLIITGLQAQDEATYYCQSYDSSLSGYVFGTGTKLTVL | ADI-41206 | Light chain variable region ("LC") amino acid sequence |
| Ab 531 | 1061 | QVQLVQSGPALVKPTQTLTLTCTFSGFSLSTKGMCVSWIRQPPGKALEWLALIDWD DDKFYSTSLKTRLTIISKDTSKNQVVLTMTNMDPVDTATYYCARTLFYGSGSLSDYC FDYWGQGTPVTVSS | ADI-41207 | Heavy chain variable region ("HC") amino acid sequence |
| Ab 531 | 1062 | QPVLTQPRSVSGSPGQSVTISCTGTSRDVGNYNFVSWYQQHPGKAPKLIIYDVTKR PSGVPDRFSGSKSGNTASLTISGLQAEDEADYYCCSYAGTYTWVFGGGTKVTVL | ADI-41207 | Light chain variable region ("LC") amino acid sequence |
| Ab 532 | 1063 | QVQLVESGGDLVKPGGSLRLSCAASGFTLSGHYMSWIRQPPGKGLEWVSSISGGST YTNYADSVKGRFTISRDNAENSLYLQMNSLRAEDTAVYYCARLAYSDYGPYFDLW GRGTLVTVSS | ADI-41208 | Heavy chain variable region ("HC") amino acid sequence |
| Ab 532 | 1064 | QSVLTQPPSVSGAPGQRVTISCTGSSNIGAGYDVHWYQQLTGTAPKLLIFDNNNR PSGVPDRFSGSKSGTSASLAITGLQAEDEADYYCQSYDSRLSAPYVFGTGTKLTVL | ADI-41208 | Light chain variable region ("LC") amino acid sequence |
| Ab 533 | 1065 | QVQLQESGAGLLKPSETLSLTCAVSGASFSGYSWSWIRQPPGKGLEWIGDIDHSGS TNYNSSLNSRVTISVDTSKNQFSLNLTSVTAADTAIYYCARVGGRSAYWGQGTLVTV SS | ADI-41209 | Heavy chain variable region ("HC") amino acid sequence |
| Ab 533 | 1066 | DIVMTQSPLSLPVTPGEPASISCRSSQSLLHSNGFNYLDWYLQKPGQSPQLLIYLGSN RASGVPDRFSGSGSGTDFTLKISRVEAEDVGVYYCMQALQLTFGGGTKVEIK | ADI-41209 | Light chain variable region ("LC") amino acid sequence |
| Ab 534 | 1067 | QVQLVQSGAEVKKPGASVKVSCKASGYTFNNYGISWVRQAPGQGLEMGWLSA YNGDIKYAQKFQGRVTVTTDTSTSTAYMELRSLRSDDTAVYYCARDTPVGGGTQTF DYWGQGTLVTVSS | ADI-41210 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 534 | 1068 | ETTLTQSPLSLPVTLGQPASISCRSSQSLVHSNGNTYLNWFQQRPGQSPRRLIYTVS NRDSGVPDRFSGSGSGTDFTLKISRVEAEDVGVYYCMQATHRPGTFGQGTKVEIK | ADI-41210 | Light chain variable region ("LC") amino acid sequence |
| Ab 535 | 1069 | EVQLLESGAEVKKPGASVKVSCKASGYTFTDYIHWVRQAPGQGLEWMGRINPKN GDAIYAQNFQGRVTMTRDTSISTAYMEVSRLTSDDTAVYYCARDQMWLVLDYWG QGTLVTVSS | ADI-41212 | Heavy chain variable region ("HC") amino acid sequence |
| Ab 535 | 1070 | QSALTQPASVSGSPGQSITISCTGTSSDVGGYDYVSWYQQHPGKAPKLMIHDVTN RPSGISHRFSGSKSGNTASLTISGLQAGDEADYYCCSSYTRSNTKVFGTGTKVTVL | ADI-41212 | Light chain variable region ("LC") amino acid sequence |
| Ab 536 | 1071 | EVQLVESGGGLIQPGGSLRLSCAASGFTVSSNYMSWVRQAAGKGLEWVSLIYSGD STYYADSVKGRFTISRDNSQNTLYLQMNSLRAEDTAVYYCARDASPNVGYYGMDV WGQGTTVTVSS | ADI-41213 | Heavy chain variable region ("HC") amino acid sequence |
| Ab 536 | 1072 | DIVLTQPPSVSVSPGQTASITCSGGKLGDTYACWYQQKPGQSPVLVIYQDSKRPSGI PERFSGSNSGNTATLTIISGTQAMDEADYYCQAWDSSTARYVFGTGTKVTVL | ADI-41213 | Light chain variable region ("LC") amino acid sequence |
| Ab 537 | 1073 | EVQLVESGGGLVQPGGSLRLSCAASGFTFSSYWMSWVRQAPGKGLEWVATIKQD GSEKYSVDSVKGRFTISRDNPKKSLYLQMNSLRAEDTAVYYCARDYRVEYYHSSDKL KRYYYYGMDVWGQGTTVTVSS | ADI-41214 | Heavy chain variable region ("HC") amino acid sequence |
| Ab 537 | 1074 | DIRVTQSPSSLSASVGDRVTITCRASQSISTYLNWYQQKPGKAPKFLIYAASSLESGVP SRFSGSGSGTDFSLTISSLQPEDFATYYCQQSYSIPITFGQGTRLEIK | ADI-41214 | Light chain variable region ("LC") amino acid sequence |
| Ab 538 | 1075 | QVQLVESGGGVVRPGGSLRLSCAASGFTFDDYGMSWVRQAPGKGLEWMSGINW SGGSTDYADSVKGRFTISRDNAKNSLYLQMNSLRAEDTALYYCAKEGQEWELLPW YFDLWGRGTLVTVSS | ADI-41215 | Heavy chain variable region ("HC") amino acid sequence |
| Ab 538 | 1076 | QPVLTQPASVSGSPGQSITIPCTGTSSDVGIYNLVSWYQQHPGKAPKLMIYDVSKRP SGVSNRFSGSKSGNTASLTISGLQAEDEADYYCSSYAGGSTYVFGTGTKLTVL | ADI-41215 | Light chain variable region ("LC") amino acid sequence |
| Ab 539 | 1077 | EVQLVESGGGLVKPGESLRLSCAASGFRFSDHYMSWIRQAPGKGLEWISYISSSSYI HYADSVTGRFTISRDNAKNSMVLQMNSLRAEDTAVYYCAREIGRSYYMDVWGKG TTVTVSS | ADI-41216 | Heavy chain variable region ("HC") amino acid sequence |
| Ab 539 | 1078 | QSALIQPPSVSGAPGQRVTISCTGSSSNIGAGYDVHWYQQLPGTAPKLLIYGNNNR PSGVPDRFSASKSGISASLAITGVQTEDEADYYCQSYDRSLSEFYVFGSGTKVTVL | ADI-41216 | Light chain variable region ("LC") amino acid sequence |
| Ab 540 | 1079 | EVQLVQSGGGLVKPGGSLRLCVASGFTFSSYSMNWVRQAPGKGLEWVSSISASSS YIDYADSVKGRFTISRDNDKKSLYLQMSSLRAEDTAVYYCAREDYDSLTGYYSPKRFD PWGQGTIVTVSS | ADI-41217 | Heavy chain variable region ("HC") amino acid sequence |
| Ab 540 | 1080 | QSVLTQPPSLSGAPGQRVTISCTGSSSNIGAGYDVHWYQQLPGTAPKLLIYGNNNR PSGVPDRFSGSKSGTSASLAITGLQAEDEADYYCQSYDRSLSVVFGGGTKVTVL | ADI-41217 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 541 | 1081 | QVQLVQSGAEVKKPGASVKVSCKASGYTFISDGISWVRQAPGQGLEMMGWINPH NENTNYAQKFQGRVTMTDTSTAYLELRGLRSDDTAVYYCARDPYHWSYLDYW GQGTLVTVSS | ADI-41218 | Heavy chain variable region ("HC") amino acid sequence |
| Ab 541 | 1082 | QSVVTQPPSVSGAPGQRVTITCTGSSNIGANSDVHWYQQIPGTAPKLLIFGNSNR PSGVPDRFSGSKSGTSASLAITGLQAEDEADYYCQSYDRSLSGSRVFGGGTRLTVL | ADI-41218 | Light chain variable region ("LC") amino acid sequence |
| Ab 542 | 1083 | EVQLVESGGGLVQPAGSLRLSCAASGFTFSNYVMNWVRQAPGKGLEWVSYISSSG RTIHYADSVKGRFTISRDNAKNSLYLEMNSLRAEDTAVYYCARDPNYGGNSNRFDS WGQGTLVTVSS | ADI-41219 | Heavy chain variable region ("HC") amino acid sequence |
| Ab 542 | 1084 | DIVMTQTPSSLSASVGDRVTITCRASQTISNYLNWYQQKPGKAPKLLIFAASSLQSG VPSRFSGSGSGTDFTLTISSLQPEDFATYYCQQSYSAPRVTFGPGTKVDIK | ADI-41219 | Light chain variable region ("LC") amino acid sequence |
| Ab 543 | 1085 | EVQLLESGGGLVKPGGSLRLSCAASGFTFSDYTMNWVRQAPCKGLEWVSSISITSS HIYYADSVKGRFTISRDNAKNSLYLQINSLRAEDTAAYYCARELGFASSSYSYYGMD VWGQGTTVTVSS | ADI-41221 | Heavy chain variable region ("HC") amino acid sequence |
| Ab 543 | 1086 | QSALTQPRSVSGSPGQSVTISCTGTSSDVGDYNSVSWYQQHPGTAPKLIIFDVTQR PSGVPDRFSGSKSANTASLTISGLQPEDEADYYCCSFAGNYVFGTGTKVTVL | ADI-41221 | Light chain variable region ("LC") amino acid sequence |
| Ab 544 | 1087 | QVTLKESGGGVVQPGRSQRLSCTASGFNFHNYAMHWVRQAPGKGLEWVAVLSY DGSNKNFADSVKGRFTISRDNSKNTLNLQMNNLRAEDTAVYYCVRDIVRGSPLFDY WGQGTLVTVSS | ADI-41222 | Heavy chain variable region ("HC") amino acid sequence |
| Ab 544 | 1088 | QPVLTQPPSLSVAPGQTAWITCGGNNIGSKIVHWYQQKPGQAPVVVYDDDDRP SGIPERFSGSNSGNTATLTIRRVEVGDEADYYCQVWDRSSDNYVFGTGTKVSVL | ADI-41222 | Light chain variable region ("LC") amino acid sequence |
| Ab 545 | 1089 | QVQLVESGGGVVQPGRSLRISCAASGFTFSNYGMHWVRQAPGKGLEWVAVLSYD GSNEYYADSVKGRFTISRDNSKNTLYLQMNSLRAEDTAVYYCAKNLNDYNISWYKC FDLWGRGTLVTVSS | ADI-41223 | Heavy chain variable region ("HC") amino acid sequence |
| Ab 545 | 1090 | QPVLTQPASVSGSPGQSITISCTGTSSDVGGYNYVSWYQHHPGKAPKLLIIYDVNNR PSGVSNRFSGSKSGNTASLTIISGLQAEDEADYICSSYTTITTFVVFGGGTKLTVL | ADI-41223 | Light chain variable region ("LC") amino acid sequence |
| Ab 546 | 1091 | EVQLVETGGGLVQPGRSLRLSCTASGFTFGDYAMNWVRQAPGKGLEWIGIIRTKT YGGTTEYAASVKGRFTISRDDSKGIAYLQMNSLKTEDTGVYCTMPVLNMDVWG QGTTVTVSS | ADI-41224 | Heavy chain variable region ("HC") amino acid sequence |
| Ab 546 | 1092 | QPVLTQPHSVSESPGKTVTISCTRNIGNIASNYVQWVQQRPGSSPTTVIYEDNQRPS GVPDRFSGSIDISSNSASLTIISGLKTEDEADYYCQSYDSNNPWVFGGGTQLTVL | ADI-41224 | Light chain variable region ("LC") amino acid sequence |
| Ab 547 | 1093 | EVQLVESGGGLVKPGGSLRLSCAASGFSLSDYYMTWLRQAPGKGLEWVSSIGTTST YTNYAESVKDRFTISRDNAKNSLYLQMNSLRAEDTAVYYCARDWGRGVERGYFDL WGRGTLVTVSS | ADI-41225 | Heavy chain variable region ("HC") amino acid sequence |
| Ab 547 | 1094 | DIVLTQTPSTLSASVGDRVTITCRASQSISFWLAWYQQKPGKAPKLLIYKASTLESGV PSRFSGRGSGTDFTLTISSLQPDDFATYYCQQYNTYTWTFGGGTKVEIK | ADI-41225 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 548 | 1095 | EVQLVESGGGLVKPGGSLRLSCAASRFTFAGYYMSWIRQAPGKGLEMVSDISPSST YTNYADSVKGRFTISRDNAGTSVSLQMDSLRADDTAVYYCARITPYGGSHYFDSWG QGTLVTVSS | ADI-41226 | Heavy chain variable region ("HC") amino acid sequence |
| Ab 548 | 1096 | QPVLTQPPSVSGAPGQRVTISCTGSSSNIGAGYDLHWYQQLPGTAPKLLIYGNSNR PSGVPDRFSGSKSGTSASLAITGLQAEDEADYYCQSYDNSLSGFYVPGTGTKVTVL | ADI-41226 | Light chain variable region ("LC") amino acid sequence |
| Ab 549 | 1097 | RSSWCSVGAEVKKRGSSVKVSCKASGTFGGYAVSWVRQAPGQGLEMMGGIIP MFYTTKYAQKLQGRVTITADESTNTAYMDLSLTSDDTAIYFCAREMHLGRTAVTG TGAFLDAFDIWGQGTMVTVSS | ADI-41227 | Heavy chain variable region ("HC") amino acid sequence |
| Ab 549 | 1098 | SYELTQPPSVSEAPRQRVTISCSGSSSNIGNNAVNWYQQLPGKAPKLLIYDDLLPS GVSDRFSGSKSGTSASLAISGLQSEDEADYYCSAWDDSLNGWVFGGGTKLTVL | ADI-41227 | Light chain variable region ("LC") amino acid sequence |
| Ab 550 | 1099 | EVQLLESGPGLVKPSETLSLTCTVSGGSISSYQWNMIRQPPGKGLEWLGYVYYSGST NYNPSLKSRVILSVDTSKNQFSLKLSSVTAADTAVYYCARDRRDGSFVFDYWGQGT LVTVSS | ADI-41228 | Heavy chain variable region ("HC") amino acid sequence |
| Ab 550 | 1100 | QSVLIQPASVSGSPGQSITISCTGTSSDVGGYNYVSWYQQHPGKAPKLMIYDVSNR PSGISNRFSGSKSGNTASLTIISGLQAEDEADYYCSSYTSSTTLVFGTGTKVTVL | ADI-41228 | Light chain variable region ("LC") amino acid sequence |
| Ab 551 | 1101 | QVQLVQSGGGVVQPGRSLKLSCAASGFTFKSYGMHWVRQAPGKGLEMVAVISYD EINKYYADSVKGRFTISRDYSKNTLSLQMNSLTTEDTAMYYCAKPKTTGYYYLDAFD FWGQGTMVTVSS | ADI-41229 | Heavy chain variable region ("HC") amino acid sequence |
| Ab 551 | 1102 | ETTLTQPSSLSASVGDRVTITCQASQDISNYLNWYQQKPGKAPKLLIYDASNLETG VPSRFSGSGSGTDFTFTISSLQSEDIATYYCQQHDNVPPITFGQGTKVDIK | ADI-41229 | Light chain variable region ("LC") amino acid sequence |
| Ab 552 | 1103 | QVQLVQSGAEVKKPGESLKISCKASGYSFTSHYWIGWVRQMPGKGLEWMGIIFP GDSDTRYSPSLQGQVTISADKSTNTAYLQWNSLKASDTAMYYCARLEYLVSGFEYW GQGGTLVTVSS | ADI-41230 | Heavy chain variable region ("HC") amino acid sequence |
| Ab 552 | 1104 | QPGLTQPHSVSESPGKTVTISCTRSSGSISNYVHWYQQRPGSFPTTVIYEDNQRPS GVPDRFSGSIDSSSNSASLTISGLRTEDEADYYCQSYDSSNPVVFGGGTKVTVL | ADI-41230 | Light chain variable region ("LC") amino acid sequence |
| Ab 553 | 1105 | QVQLVQSGAEVKKPGESLKISCKGSGYSFTNNWVGWVRQMPGKGLEMMGIIFPG DSDTRYSPSFRGQVTISVDTSINTAFLQWNSLGASDTAMYYCAMTDYNYSFKSWG QGTLVTVSS | ADI-41231 | Heavy chain variable region ("HC") amino acid sequence |
| Ab 553 | 1106 | NFMLTQPHSVSESPGKTITISCTRSSGNIGNNYVQWYQQRPGSSFTTVIYEDYQRPS GVPDRFSGSIDSSSNSATLTISGLKTEDEADYYCQSYDSSNPYVFGTGTKVTVL | ADI-41231 | Light chain variable region ("LC") amino acid sequence |
| Ab 554 | 1107 | QVQLVQSGAEVKKPGASVKVSCKASGYTFTHYGISWVRQAPGQGLEMMAMLSAY NGNTNVYAQKLQDRVIVTIDTSTSTAYMELRSLRSDDTALYYCARDSMGGTTLFDY WGQGTLVTVSS | ADI-41232 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 554 | 1108 | DIVLTQTPLSLPVTLGQPASISCRSSQSLVVSDGNTYLNWFQQRPGQSPRRLIYKVSNRDSGVPDRFTGSGSGTDFTLKISRVEAEDVGVYYCMQGTHWPPMYTFGQGTKLEIK | ADI-41232 | Light chain variable region ("LC") amino acid sequence |
| Ab 555 | 1109 | EVQLLESGGGLVKPGGSLRLSCAASGFIFRDYYMIWIRQAPGKGLEWVSYISSSSTYTNNADSVKGRFTISRDNAKNSLYLQMNSLRAEDTAVYYCARLFASRSDGAFDIWGQGTTVTVSS | ADI-41233 | Heavy chain variable region ("HC") amino acid sequence |
| Ab 555 | 1110 | QSVLTQPPSVSGAPGQRVTISCTGSSSNIGAGYDVHWYQQLPETAPKLLIYDNNNRPSGVPDRFSGSKSGTSASLAITGLQAEDEADYYCQSYDSSLSGYVPGTGTTVTVL | ADI-41233 | Light chain variable region ("LC") amino acid sequence |
| Ab 556 | 1111 | QVQLVQSGGGVVQPGRSLRLSCAASGFTVSSYAIHWVRQSAGKGLEWVAVEGRFTISRDNSKNTLYLQMNSLRAEDTAVYYCARLSEALVEPAAHTQYKVHYGLDVWGQGTTVTVSS | ADI-41234 | Heavy chain variable region ("HC") amino acid sequence |
| Ab 556 | 1112 | EIVLTQSPLSLPVTPGEPASISCKSSQSLLDSNGYNYLDWYLQKPGQSPQLLIYLVSNRASGVPDRFSGSGSGTDFTLKISRVEAEDVGIYYCMQALQTPWTFGQGTKVEIK | ADI-41234 | Light chain variable region ("LC") amino acid sequence |
| Ab 557 | 1113 | QVQLQQWGAGLLKPSETLSLTCGVYGESFSGHYWSWIRQPPGKGLEWMGEIHHSGTTNYNPSLKSRVTISVDTSKNQFSLKLNSVTAADTAVYYCARNPAEDILTGYSPPFHYYYMDVWGKGTTVTVSS | ADI-41235 | Heavy chain variable region ("HC") amino acid sequence |
| Ab 557 | 1114 | QSVLIQPPSVSGAPGQRVTISCTGSSSNIGAGYDVHWYQQIPGTAPKLLIHSNNNRPSGVPDRFSGSKSGTSASLAITGLQAEDEADYYCQSYDSSLSVVFGGGTKLTVL | ADI-41235 | Light chain variable region ("LC") amino acid sequence |
| Ab 558 | 1115 | QVQLVQSGGGLVKPGGSLRLSCTASGFTFSDYYMDWIRQAPGKGLEWVSSISSSSTYTKYADSVKGRFTISRDNAKNSLFLQMNSLRAEDTAVYYCVRNLGPYCSSTSCFVFDYWGQGTLVTVSS | ADI-41236 | Heavy chain variable region ("HC") amino acid sequence |
| Ab 558 | 1116 | QSVLTQPPSVSGAPGQRVSISCTGSSSNIGAGYEVHWYKQVPGTAPRLLMYDNTNRPSGVPDRVSGSKSGTSASLAITGLQAEDEADYYCQSYDNSLNKSVFGGGTKVTVL | ADI-41236 | Light chain variable region ("LC") amino acid sequence |
| Ab 559 | 1117 | EVQLLESGGGLVKPGGSLRLSCAASGFTFSDYYMNWIRQAPGKGLEWVSDISPSSSYTNYADSVKGRFTISRDNAKNSLYLQMNSLRAEDTAMYYCARRGSCTGGVCSFDYWGQGTLVTVSS | ADI-41237 | Heavy chain variable region ("HC") amino acid sequence |
| Ab 559 | 1118 | QPGLTQPPSVSGAPGQRVTISCTGSSSNIGAGYDVNWYQQLPGTAPKLLIYDNSNRPSGVPDRFSGSKSGTSASLAITGLQAEDEADFYCQSYDSSLSGFVPGTGTKVTVL | ADI-41237 | Light chain variable region ("LC") amino acid sequence |
| Ab 560 | 1119 | EVQLLESGGGLVKPGGSLRLSCAASGFTFRDYYMSWIRQAPGKGLEWVSYISSSSSSYTEYADSVKGRFTISRDNAKKSLYLQMNSLRTEDTAVYYCARVITQAGTGTTYYMDVWGKGTTVTVSS | ADI-41238 | Heavy chain variable region ("HC") amino acid sequence |
| Ab 560 | 1120 | QSVLTQPPSVSGAPGQRVTISCTGSSSNIGTYGVDVHWYQQLPGTAPKLLIYANNNRPSGVPDRFSGSKSGTSASLAITGLQAEDEADYYCQSYDSSLVFGGGTKLTVL | ADI-41238 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 561 | 1121 | QITLKESGPTLVKPTQTLTLTCTFSGFSLTTTGVGVWIRQPPGKALEWLALIYWDD DKRYSPSLKNRITITKDTSKKQVVLTMTNMDPADTATYYCAHISTVTYDSSGSYYVL INWFDPWGQGTLVTVSS | ADI-41239 | Heavy chain variable region ("HC") amino acid sequence |
| Ab 561 | 1122 | EIVMTQSPLSLPVTPGEPASISCRSSHSLLHSNGYNYLDWYLQKPGQSPQLLIYLGSN RASGVPDRFSGSGSGTDFTLKISRVEAEDVGVYYCMQALQTPLTFGQGTKVDIK | ADI-41239 | Light chain variable region ("LC") amino acid sequence |
| Ab 562 | 1123 | QVQLQQWGAGLLKPSETLSLICDVYGGSFSDYYWSWIRQSPGKGLEWIGEINHSG STSFHDSLKSRISISIDTSNNQFSLNLSSMTAADTAVYYCARGTLRGYFDYWGQGTLV TVSS | ADI-41240 | Heavy chain variable region ("HC") amino acid sequence |
| Ab 562 | 1124 | EIVLTQSPSTLSAFVGDRVTITCRASQSISRMLAWYQQKPGKAPNLLISRASSLESGV PSRFSGSGSGTEFTLTISSLQPDDLGTYYCQQYNGYLMTFGQGTKVEIK | ADI-41240 | Light chain variable region ("LC") amino acid sequence |
| Ab 563 | 1125 | QVQLVQSGAEVKKPGASVQVSCKASGYTFTGDYMHWVRQAPGQGLEWMGRIN PNSGGTNYAQKFQGRVTMTRDTSISTAYMELSRLRSDDTAVYYCARAAAEYSSSSP TSYYYMDVWGKGTTVTVSS | ADI-41241 | Heavy chain variable region ("HC") amino acid sequence |
| Ab 563 | 1126 | EIQMTQSPSSLSASVGDRVTITCRASQNIYSFLNWYQQKPGKAPKLLIYAASSLQSG VPSRFSGSGSGATDFTLTISSLQPEDFATYYCQQSYSPPQITFGQGTKVDIK | ADI-41241 | Light chain variable region ("LC") amino acid sequence |
| Ab 564 | 1127 | EVQLVESGGGVVQPGRSLRLSCAASGFPSSYAMHWVRQAPGKGLEWVAVIWFE GNEKYFADSVEGRFTISRDNSKNTLYLQMNSLRAEDTARYYCARFYFGAFDIWGQG TLVTVSS | ADI-41242 | Heavy chain variable region ("HC") amino acid sequence |
| Ab 564 | 1128 | DIVMTQSPLSLPVTPGEPASISCRSSQSLLHSNGYNSLDWYLQKPGQSPQLLIYLASN RASGVPDRFSGSGSGTDFTLKISRVEAEDVGVYYCMQALQTPYTFGQGTKVEIK | ADI-41242 | Light chain variable region ("LC") amino acid sequence |
| Ab 565 | 1129 | QVQLVQSRAEVKKPGESLKISCKGSLHSFSNNWIGWVRQMPGKGLEWMGIIFPD DSDTRYSPSFQQVTIISADKSISTAYLQWSSLKASDTAIYYCGTVVTLIQGVADWGQ GTLVTVSS | ADI-41243 | Heavy chain variable region ("HC") amino acid sequence |
| Ab 565 | 1130 | QPVLTQPHSVSESPGKTVTISCTRSSGSIDSSYVQNVQQRPGSSPTTVIYEDNLRPSG VPDRFSGSIDSSSNSASLTISGLKTEDEAEYYCQSTDSSNPVVFGGGTKLTVL | ADI-41243 | Light chain variable region ("LC") amino acid sequence |
| Ab 566 | 1131 | QVTLKESGGGLIQPGGSLRLSCAVSGFTVSSKYMSWVRQAPGKGLEWVSVIYGGG STYYTDSVKGRFTISRDNSNNTLYLQMNSLRAEDTAIYYCAREARSYNYDYVGNDAF DIWGQGTTVTVSS | ADI-41244 | Heavy chain variable region ("HC") amino acid sequence |
| Ab 566 | 1132 | DIVLTQTPDSLAVSLGERATINCKSSQSVLNNFPNNKNYLAWYQQKPGQPPKLLIYW ASTRESGVPDRFSGSGSGTDFTLTITSLQAEDVAIYYCQQYYRTPYTFGQGTKVDIK | ADI-41244 | Light chain variable region ("LC") amino acid sequence |
| Ab 567 | 1133 | QVQLVESGGGLVKPGGSLRLSCAASGFSSAYYMSWIRQAPGKGLEWISNLSGGSS YANYADSVEGRPTISRDNAKNSLYLQMNSLRAEDTAVYYCAREFQTYYMDVWGK GTTVTVSS | ADI-41245 | Heavy chain variable region ("HC") amino acid sequence |
| Ab 567 | 1134 | QPVLTQPPSVSGAPGQRVTISCTGSSNIGAGYEVHWYQQLPGTAPKLLIYGNNNR PSGVPDRFSGSKSGTSASLAITGLQAEDEADYYCQSYDSSLSGSVFGGGTKLTVL | ADI-41245 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 568 | 1135 | EVQLLESGPGLVKPSETLSLTCIVSGGSISSYNWMIRQPPGKGLEMIGYIYNSGSTN YNPSLKSRVTISVDTSKNQFSLKLSSVTAADTAVYYCARYFDYGSGFDYWGQGTLV TVSS | ADI-41246 | Heavy chain variable region ("HC") amino acid sequence |
| Ab 568 | 1136 | ETTLIQSPGILSLSPGERATLSCRASQSVTSTYLAWYQQKPGQAPRLLIYGASSRAT GIPDRFSGSGSGTDFTLTISRLEPEDFAVYYCQQFDSSLIFGGGTKVEIK | ADI-41246 | Light chain variable region ("LC") amino acid sequence |
| Ab 569 | 1137 | QVQLVQSGAEVKKPGASLQVSCKASGYTFTDSYFHNVRQAPGQGLEMMGRISPH SGGTNYAQKFQGRVTMTRDTSISTAYLELSRLRSDDTAVYYCATEGPRGPRFDPW GQGTLVTVSS | ADI-41247 | Heavy chain variable region ("HC") amino acid sequence |
| Ab 569 | 1138 | NFMLTQPHSVSESPGKTVTISCTRSSGSIASNYVQWYQQRPGSSPTTVIYEDNQRPS GVPDRFSGSIDSSSNSASLTISGLMTEDEADYYCQSYDSSNWFGGGTKLTVL | ADI-41247 | Light chain variable region ("LC") amino acid sequence |
| Ab 570 | 1139 | QVQLVQSGGGVVQPGRSLRLSCAASGFTFSSYSMHWVRQAPGKGLEWMAVCW YDGSNIYYADSVKGRFTISRDNSKNTVYLQMNSLRAEDTAVYYCARDDRYCSGGTC LSAFDIWGQGTMVTVSS | ADI-41248 | Heavy chain variable region ("HC") amino acid sequence |
| Ab 570 | 1140 | ETTLIQSPSSLSASVGDRVTITCRASQSISSYLNWYQQKPGKAPKLLIYTTSSLQSGVS SRFSGSGSGTDFTLTINSLQPEDFATYYCQQSYSTPNTFGQGTKVEIK | ADI-41248 | Light chain variable region ("LC") amino acid sequence |
| Ab 571 | 1141 | QVQLVQSGAEVKKPGESLKISCQVSRDTSTTYWIGWVRQMPGKGLEWMGIIFPG DSDTRYSPSFQGQVTISADKSIMTAYLQLTSLKASDTAMYCATQALRGAPFDIWGQ GTMVTVSS | ADI-41249 | Heavy chain variable region ("HC") amino acid sequence |
| Ab 571 | 1142 | DIRLTQPSSLSASVGDRVTITCQASQDISNYLNWYQQKPGKAPKLLIFTFGPGTKLEIK PSRFSGSGSGTDFTFTISSLQPEDFATYYCQQYDDLLFTGPGTKLEIK | ADI-41249 | Light chain variable region ("LC") amino acid sequence |
| Ab 572 | 1143 | QVQLQQWGAGLLKPSETLSLTCAVSGGSLITGYFWSWIRQPPGKGLEWIGEVSHSG STNYNPSLKSRVIMSVDTSKTQFSLKLNSVTAADTAVYYCARGYDYWSGTARYFDY WGQGILVTVSS | ADI-41250 | Heavy chain variable region ("HC") amino acid sequence |
| Ab 572 | 1144 | QPVLTQPASVSGSPGQSITISCTGTSSDVGGYNYVSWYQQHPGKAPKLMIYDVSNR PSGVSSRFSGSKSGNTASLTISGLQAEDEGDYCCSSYRSSTTSRVFGGGTKVTVL | ADI-41250 | Light chain variable region ("LC") amino acid sequence |
| Ab 573 | 1145 | EVQLVESGGGLVKPGGSLRLSCAASGFTFSDYYMTWIRQAPGKGLEMVSNISGGSS YTNYADSVKGRFTISRDNAKNSVYLQMNSLRAEDTAVYYCARVGCSGGVCNFFLDY WGQGTLVTVSS | ADI-41251 | Heavy chain variable region ("HC") amino acid sequence |
| Ab 573 | 1146 | QSVLTQPPSVSGAPGQRVTISCTGSSSNIGAGYDVHWYQQLPGTAPKLLIYDNTNR PSGVPDRFSGSKSGTSASLAITGLQAEDEADYYCQSYDSSLSGYVFGTGTKVTVL | ADI-41251 | Light chain variable region ("LC") amino acid sequence |
| Ab 574 | 1147 | EVQLVQSGAEVKKPGESLKISCMGSGYNFPNYWIGWVRQMSGKGLEWMGIIYPD DSDTTYSPSFQGQVIFSADKSISTAYLQWSSLKASDTAMYFCVRLLDKTTQIDFWGQ GTLVTVSS | ADI-41252 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 574 | 1148 | EIVLTQSPSSLSASVGDRVTITCQASQDISNYLNWYQQKPGKAPKLLIYDVSNLETGV PSRFSGSGSGTDFTFTISSLQPEDIATYYCQQHDNLPLTFGGGTRLEIK | ADI-41252 | Light chain variable region ("LC") amino acid sequence |
| Ab 575 | 1149 | EVQLVQSGPGLVKPSETLSLTCTVSGDSISSSDYSYWGWIRQPPGKGLEWIASLSYS GKTYSQSSLKSRVIISVDTSKKQFSLKLSSVTAADTAVYYCAVTRCYVCTSEGDSFDM WGQGTMVTVSS | ADI-41253 | Heavy chain variable region ("HC") amino acid sequence |
| Ab 575 | 1150 | DIVLTQTPGTLSLSPGERATLSCRASQSISGNYLAWYQHKPGQAPRLLIYGASTRATG IPDRFSGSGSGTDFPLTISRLEPEDFAVYYCQQYAISPYITFGQGTKVDIK | ADI-41253 | Light chain variable region ("LC") amino acid sequence |
| Ab 576 | 1151 | EVQLVESGGGLVQSGGSLRLSCAASGFTFSSYEMNWVRQAPGKGLEWVSYTTNN GRTIYYADSVKGRFTISRDNAKNSLFLQMNGLRAEDTAVYYCARGIQFSRVDYAMD VWGQGTTVTVSS | ADI-41254 | Heavy chain variable region ("HC") amino acid sequence |
| Ab 576 | 1152 | SYELTQPPSVSGTPGQRITISCSGSSSNIASNTVNWYQHLPGTAPKLLIYSDNQRPSG VPDRFSGSKSGTSASLAISGLQSEDEADYYCAIWDDSLNASYVFGTGTKLTVL | ADI-41254 | Light chain variable region ("LC") amino acid sequence |
| Ab 577 | 1153 | EVQLVESGGGLVQPGGSLRLSCAASGLTFSSYAMSWVRQAPGPGQGLEMVSSVSGSG VSTYYADSVKGRFTISRDNSKNTLYLQMNSLRAEDTAVYYCAKEDYYHFYMDVWG NGTTVTVSS | ADI-41255 | Heavy chain variable region ("HC") amino acid sequence |
| Ab 577 | 1154 | ETTLTQSPATLSVSPGERATLSCRASQSVSSNLAWYQQKPGQAPRLLIYGASTRAAG IPARFSGSGSGTEFTLTISSLQSEDFAVYYCQQHDNWPSYTFGQGTKVEIK | ADI-41255 | Light chain variable region ("LC") amino acid sequence |
| Ab 578 | 1155 | QVQLVQSGAEVKSPGSSATVSCKAASGTFGSYGISWVRQAPGQGLEMIGAIMPM FGTTNYAQKFQGRVTMTADESTSTVYMDVSSLRPDDTAVYYCVRDVFYDILTGYYD ADYYHHYMDVWGKGTTVTVSS | ADI-41256 | Heavy chain variable region ("HC") amino acid sequence |
| Ab 578 | 1156 | DIVMTQSPLSLPVTLGQPASISCRSGQSLVHSDGNTYLNWFQQRPGQSPRRLIYKV SNRGSGVPDRFSGSGSGTDFTLKISRVEAEDVGVYFCMQGTHWPRTFGQGTKVDI K | ADI-41256 | Light chain variable region ("LC") amino acid sequence |
| Ab 579 | 1157 | QVQLVESGAEVKKPGSSVKVSCKASEGTFSSYGISWVRQAPGQGPEWMGEINPM FGTAKYAQKFQGRVTITVDESTSTADMELSSLTSEDTAVYYCAREFLGQCSETNCPT PSRHLDYWGQGTLVTVSS | ADI-41257 | Heavy chain variable region ("HC") amino acid sequence |
| Ab 579 | 1158 | EIVMTQSPSSLSASVGDRVTITCRASRTISSYLNWYQQKPGKAPKLLIYATSNLQSGV PSRFSGSGSGADFTLTISSLQPEDFATYYCQQTYSTPGFGPGTKVDIK | ADI-41257 | Light chain variable region ("LC") amino acid sequence |
| Ab 580 | 1159 | QVQLVQSGGGLVQRGGSLRLSCAASGFSFRSYAMSWVRQAPGKGLEMVSSISDS GDNTFYADSVKGRFSISRDNSRDTLYLQMNSLRAEDTAVYYCARGGYCSGGNCFPF DYWGQGTLVTVSS | ADI-41258 | Heavy chain variable region ("HC") amino acid sequence |
| Ab 580 | 1160 | SYELMQLPSVSVSPGQTARITCSGDALPKQYGYWYQQKPGQAPVLVIYKDSERPSG IPERFSGSSGTTVTLTISGVQAEDEADYYCQSADSGGTYVMFGGGTKLTVL | ADI-41258 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 581 | 1161 | QVQLVESGGRLVKPGGSLRLSCAASGFTFSDFYMSWIRQAPGKGLEWVSISSSGD DPNYADSVKGRFTISRDNSKNSLYLQMNSLRAEDTAVYYCARDEVGMNNLDYYFG MDVWGQGTTVTVSS | ADI-41259 | Heavy chain variable region ("HC") amino acid sequence |
| Ab 581 | 1162 | DIVMTQSPLSLPVTLGQPASISCRSSQSLVHSDGNTYLSWFHQRPGQSPRRLIYKVS NRDSGVPNRFSGGGSGTDFTLKISRVEAEDVGFFYCMQGTHWQKTFGQGTKVEIK | ADI-41259 | Light chain variable region ("LC") amino acid sequence |
| Ab 582 | 1163 | QVQLVQSGAEVKKPGSSVKVSCKASGGTFSSYGISWVRQAPGQGLEWMGGIIPM FGAANYAQKFQGRVTITAETSTSTAFMELSSLRSDDTAVYYCARIRMVPNWGGTA TSFYNGMDVWGQGTTVTVSS | ADI-41261 | Heavy chain variable region ("HC") amino acid sequence |
| Ab 582 | 1164 | EIVMTQSPGTLSLSPGERATLSCRASQSVSSSYLAWYQQKPGQAPRLLIYGASSRAT GIPDRFSGSGSGTDFTLTISRLEPEDFAVYYCQHYGSSLFTFGPGTKVDIK | ADI-41261 | Light chain variable region ("LC") amino acid sequence |
| Ab 583 | 1165 | QVQLVQSGAEVKKPGASVKVYCKASGYTFTSHYIHWVRQAPCQGLEWMGRMNP SGGSPMYAQKFQGRVIMTRDTSTSTAYMELRSLRSEDTAVYYCAMAKFYSFDYW GQGTLVTVSS | ADI-41263 | Heavy chain variable region ("HC") amino acid sequence |
| Ab 583 | 1166 | QSVLTQPHSVSESPGKTVTISCTRSSGSIASYFVHWYQQRPGSAPTIVIYEDNQRPSG VPDRFSGSIDSSSNSASLTISGLKTEDEADYYCQSYDSSNMVFGGGTKLTVL | ADI-41263 | Light chain variable region ("LC") amino acid sequence |
| Ab 584 | 1167 | EVQLVESGGGLVKPGGSLRLSCAASGFTFSNTWMSWVRQAPGKGLEWMGHIKSK TDGGTTDYAAPVKGRFTISRDDSKSIINLHLNSLKTEDSAVYYCAALPPISGWYYTPG FWGQGTLVTVSS | ADI-41264 | Heavy chain variable region ("HC") amino acid sequence |
| Ab 584 | 1168 | SYELTQPPSMSVSPGQTARITCFGDAVPKKKVVYWYQQKSGQAPVMVIYDDRRRPS GIPERFSGSSSGARATLTISGAQVEDEADYYCYSTDGSGNPSFGGGTKLTVL | ADI-41264 | Light chain variable region ("LC") amino acid sequence |
| Ab 585 | 1169 | EVQLVQSGAEVKKPGESLTISCKDSGYSFTSYWIGWVRQVPGKGLEWMGIVYPGD SRYSPSFQGHVTMSADKSINTAYLQWSTLKASDTAMYYCAKVVTYGSAIRWFESW GQGTLVTVSS | ADI-41265 | Heavy chain variable region ("HC") amino acid sequence |
| Ab 585 | 1170 | QSVLTQPPSVSAAPGQKVSISCSGSSSNIGNNFVSWYQQVPGTAPKLLIIDNNKRPS GIPDRFSGSKSGTSATLGITGLQTGDEADYYCGTWDSRLSAEVFGGGTKLITVL | ADI-41265 | Light chain variable region ("LC") amino acid sequence |
| Ab 586 | 1171 | QVQLQQSGPGLVKPSQTLSLTCAISGDSVSSNSAAMNWIRQSPSRGLEWLGRTYY RSKWYNDYAVSVKSRITINPDTSKNQFSLQLNSVTPEDTAVYYCARDLPQVDYFDG ASFYFDFWGQGTLVTVSS | ADI-41266 | Heavy chain variable region ("HC") amino acid sequence |
| Ab 586 | 1172 | QPVLTQPPSVSVAPGQTASITCGGNIIGNKGVHWYQQKPGRAPVLVVYDDSDRPS GIPERFSGSNSGNTATLTISRVEAADEADYYCQVWDTGSHPVVFGGGTKVTVL | ADI-41266 | Light chain variable region ("LC") amino acid sequence |
| Ab 587 | 1173 | QVQLVQSGPGLVKPSGTLSLTCAVSGGSISTTHWSWVRQPPGKGLEWIGEIYHS GSTNYNPSLKSRVTISVDKSRSQFSLKLTSVTAADTAVYYCARGDDPLCSGGICYSGYF DYWGQGTLVTVSS | ADI-41267 | Heavy chain variable region ("HC") amino acid sequence |
| Ab 587 | 1174 | SYVLTQPPSVSVSPGQTATITCSGDKLGDQYACWYQQKSGQSPVLVIYRDNKRPSG IPERFSSSNSGNTATLTISETQAMDEADYYCQAWGSSVVFGGGTKVTVL | ADI-41267 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 588 | 1175 | EVQLVESGGGLVKPGGSLRLSCVASGFGFTSYSMNWRQAPGKGLEWVSSISASST YIHYADSVKGRFTISRDNARNSLYLQMISLRADDTAVYYCSRDGPTYGSGVHVWGQ GTMVTVSS | ADI-41268 | Heavy chain variable region ("HC") amino acid sequence |
| Ab 588 | 1176 | QSALIQPVSVSGSPGQSITISCTGTRSDVGGVNYVSWYQQHPGKAPKLMIYEVRNR PSGVSDRFSGSKSGNTASLTISGLQAEDEGDYYCSSYTSSDTLFYFPGSGTKLTVL | ADI-41268 | Light chain variable region ("LC") amino acid sequence |
| Ab 589 | 1177 | EVQLVESGGGVVQPGGSLRLSCAASGFTFSSFAMHWVRQAPGKGLEWVAVISYD GSNKYYADSVKGRFTISRDNSKNTLSLQVNSLRAEDTAVYYCARVSAEGSMGRFSD FNYWGLGTLVTVSS | ADI-41270 | Heavy chain variable region ("HC") amino acid sequence |
| Ab 589 | 1178 | QSALTQPASVSGSPGQSITISCTGTSSSDVGSYNLVSWYQQHPGKAPKLMIYEVRKR PSGVSNRFSGSKSGNTASLTISGLQAEDEADYYCCSYAGSDTYVFGTGTKLTVL | ADI-41270 | Light chain variable region ("LC") amino acid sequence |
| Ab 590 | 1179 | QVQLQESGPGLVKPSQTLSLTCAISGDSVSSNNAAMNWIRQSPSRGLEWLGRTYY RSKWYNDYAVSVKSRITINPDTSKNQLSLQLNSVTPEDTAVYYCARAGVRQMLVRG MDAFDIWGQGTMVTVSS | ADI-41271 | Heavy chain variable region ("HC") amino acid sequence |
| Ab 590 | 1180 | DIRLTQSPDSLAVSLGERATVNCKSSQSVLYSSNNKNYLAWYQQKPGQPPKLLIYW ASTRESGVPDRFSGSGSGTDFTLTISSLQAEDVAVYYCQQYYNTPHTFGQGTKVEIK | ADI-41273 | Light chain variable region ("LC") amino acid sequence |
| Ab 591 | 1181 | EVQLLESGGDLVRPGGSLRLSCTASGFSFSSSEMNWVRQAPGKGLEWVASINSGG DDIYYADSVKGRFTISRDNAKNSLSLQMDSLRAEDTALYYCARSRSGYSSGWSRFPG NWGQGTLVTVSS | ADI-41273 | Heavy chain variable region ("HC") amino acid sequence |
| Ab 591 | 1182 | QSALTQPRSVSGSPGQSVTISCTGTISDIGAYNYVSWYQQHPGKAPKVMIYDVSKR PSGVPDRFSGSKSGFTASLTISGLQAEDEADYYCCSYAGRMVFGGGTKLTVL | ADI-41274 | Light chain variable region ("LC") amino acid sequence |
| Ab 592 | 1183 | EVQLVESGGGLVKPGGSLRLSCAASGFSFSSYAMNWVRQAPGKGLQWVSSISAGS SYIDYADSVKGRFTISRDNAENSLFLQMNSLRVEDTAVYYCARVGSYTHGYEFDYW GQGTLVTVSS | ADI-41274 | Heavy chain variable region ("HC") amino acid sequence |
| Ab 592 | 1184 | QPVLTQPPSVSGAPGQRVTISCTGSNSNIGAGYDVHWYQQLPGTAPKLLIYASTIRP SGVPDRFSGSKSGTSASLAITGLQAEDEADYYCQSYDRNLSVVFGGGTKVTVL | ADI-41275 | Light chain variable region ("LC") amino acid sequence |
| Ab 593 | 1185 | EVQLVESGGGLVKPGGSLRLSCAASGFMFSTYSMNWVRQAPGKGLEWVSFITGSS SDKYYAHSVKGRFTISRDNAKRTLYLQLNSLRAEDTAVYYCARFRGLYCDGDCSSRG NTYYNYGMDVWGQGTTVTVSS | ADI-41275 | Heavy chain variable region ("HC") amino acid sequence |
| Ab 593 | 1186 | EIVMTQSPLSLSVIPGEPASISCRSSKSLLHSNGTYTYLDWYLQKPGQSPQLLIHLGSNR ASGVPDRFSGSGSGTDFTLKISRVEAEDVGVFYCMQALQAPPTFGPGTKVEIK | ADI-41276 | Light chain variable region ("LC") amino acid sequence |
| Ab 594 | 1187 | EVQLVESGGGLVQPGRSLRLSCRASGFTRNYAMSWVRQAPGKGLEWVGFIRGK GYGGTTEYAASVKGRFTISSDDSRSIAYLQMNSLKTEDTAVYYCTRVREDGVIAVAE YYFDYWGQGTLVTVSS | ADI-41276 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 594 | 1188 | GIQMTQSPGTLSLSPGERATLSCRASQSVSSSYLAWYQQKPGQAPRLLIHGASSRAT GIPDRFSGSGSGTDFTLTISRLEPEDFAVYHCQQYGSSPWTFGQGTKVEIK | ADI-41276 | Light chain variable region ("LC") amino acid sequence |
| Ab 595 | 1189 | QVQLQESGPGLVKPSGTLSLTCAVSGGSITGRNWWSWVRQPPGKELERIGEIYHG GSTEYNPSLKGRVTISVDKSKNQFSLRLNSVTAADTAVYYCARVAHYDSNGYYIGYF DLWGRGTLVTVSS | ADI-41277 | Heavy chain variable region ("HC") amino acid sequence |
| Ab 595 | 1190 | EIVLTQSPPSLSASVGDRVTITCRASQSISIYLNWYQQKPGKAPKLLIFAASSLQSGVP LRFSGSGSGTDFTLTIISSLQPEDFATYYCHQSYSAPWTFGQGTKVDIK | ADI-41277 | Light chain variable region ("LC") amino acid sequence |
| Ab 596 | 1191 | EVQLVESGPALVKPTQTLTLTCTFSGFSLSTKRMGVSWIRQPPGKALEWLARIDWD DDKFYSTSLKRLTISKDTSKNQVVLTLANMDPVDTATYFCARTTVYASGGYYLYLD YWGQGTLVTVSS | ADI-41278 | Heavy chain variable region ("HC") amino acid sequence |
| Ab 596 | 1192 | DIVMTQTPSSLSASVGDRVTLTCRASQRIASYVNWHQKPGKAPNLLIYAASNLQS GVPSRFSGSGSGTDFTLTISSLQPEDFATYYCQQSYSTPLTFGQGTKLEIK | ADI-41278 | Light chain variable region ("LC") amino acid sequence |
| Ab 597 | 1193 | QVQLVQSGAEVKKAGETLKISCRGPAHTFTSFWIGWVRQTPGKGLEWMGNIYPG DTDTTYSPSFRGQVTISADKSISTAYLQWNSLKASDTAIYYCATRVRHGYSSSGSFES WGQGTMVTVSS | ADI-41279 | Heavy chain variable region ("HC") amino acid sequence |
| Ab 597 | 1194 | QSVVTQPPSVSGAPGQRITISCTGSNSNTGAGYDVHWYQQLPGAAPKLLIFANNN RPSGVPDRFSGSKSGTSASLAITGLQAEDEADYYCQSYDNSLSAVVFGTGTKLTVL | ADI-41279 | Light chain variable region ("LC") amino acid sequence |
| Ab 598 | 1195 | QVQLVESGPGLVKPSETLALTCTVSGGSLSTYYWSWIRQPPGKGLEWIGYIYYSGTT YYNPSLKSRVTISEDRSKNQFSLKLTSVTAADTAVYYCARHGPKTEFWSAQYYLELW GRGTLVTVSS | ADI-41280 | Heavy chain variable region ("HC") amino acid sequence |
| Ab 598 | 1196 | EIVLTQSPGTLSLSPGERATLSCRASQSVSSDYLAWYQQKPGQAPSLLIYGVSTRATG IPDRISGSGSGTDFTLTISRLEPEDFAVVYCHQYGTSPWTFGQGTKVEIK | ADI-41280 | Light chain variable region ("LC") amino acid sequence |
| Ab 599 | 1197 | QVQLVQSGAEVKKPGASVKVSCKASGYSFTNHGIHWVRQAPGQRLEWMGWINV ANGFTAYSQNLQGRVTFTRDTSASTAYLELTSLRSEDTAVTHCARDESYCSAGYCYL YFDYWGQGTTVTVSS | ADI-41281 | Heavy chain variable region ("HC") amino acid sequence |
| Ab 599 | 1198 | DIQVTQSPSSLSASVGDRVTITCRASQNIIITYVNWYQQKPGKAPELLIFGASSVQSG VPSRFSGSGSGTDFTLTISSLRPDDFATYYCQQSYSNPRTFGGGTKVEIK | ADI-41281 | Light chain variable region ("LC") amino acid sequence |
| Ab 600 | 1199 | QVQLVQSGGGVVQPGRSLRLSCAASGFMFTIYSMHWVRQAPGKGLEWVAVISN DGVNKYYSDSVKGRFTISRDNSKNTLYLQMNNLRAEDTAVYYCASDIVLVLVTATDY WGQGTLVTVSS | ADI-41282 | Heavy chain variable region ("HC") amino acid sequence |
| Ab 600 | 1200 | ETTLTQSPVTLSLSPGERATLSCRTSQSFSSPLLAWYQQKPGQAPRLLIYGASNRATG IPDRFSGSGSGTDFTLTISRLEPVDFAVYYCQQYGSSPYTFGQGTKLEIK | ADI-41282 | Light chain variable region ("LC") amino acid sequence |
| Ab 601 | 1201 | QVTLKESGPTLVKPTQTLTLTCTFSGFSLSTFGVAVGWIRQPPGKALEWLALIYWDD DKRYSPSLKSRLTITKDISKNQVVLTMTNMDPVDTATYYCAHRLRSLTARGVFDIWG QGTTVTVSS | ADI-41283 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 601 | 1202 | DIRLTQSPSSLSASVGDRVTITCRASQSINNFLNWYQQRPGKAPTLLIYSASSLQSGV PSRFSGSGSGTDFTLTISSLQPEDFATYFCQQTDSFPWTFGQGTKVEIK | ADI-41283 | Light chain variable region ("LC") amino acid sequence |
| Ab 602 | 1203 | QVQLVQSGGGLVKPGGSLRLSCAASGFTFSNAWMSWVRQAPGKGLEWVGRIKSE VDGGTADYAANVKGRLTISRDDSKNMYLQMNSLKTEDTAVYYCTTDPGVWIF GEVKLFRTDPEYWGQGTLVTVSS | ADI-41284 | Heavy chain variable region ("HC") amino acid sequence |
| Ab 602 | 1204 | QSVLTQPPSVSAAPGQKVTISCSGSSSNIGNHYVSWYQQLPGTSPKLLIYDNNKRPS GIPDRFSGSKSGTSATLGITGLQPGDEADYYCGTMDSSLSAVRVFGGGTKVTVL | ADI-41284 | Light chain variable region ("LC") amino acid sequence |
| Ab 603 | 1205 | QVQLVQSGAEVKKPGSSVKVSCKASGGTFSYYAISWVRQAPGQGLEWMGGIIPIL GTVKNAQKFQGRVTITADKITSIAYMELSSLRHEDTAVYYCARDYDSSGYYNGYG MDVWGQGTTVTVSS | ADI-41285 | Heavy chain variable region ("HC") amino acid sequence |
| Ab 603 | 1206 | QSVLIQPPSASGTPGQRVTISCSGSSSNIGSNYVTWYQQLPGTAPKLLIYRNDQRPS GVPDRFSGSKSGTSASLAISGLRSGDEADYYCAAWDDSLGGPIWVFGGGTKLTVL | ADI-41285 | Light chain variable region ("LC") amino acid sequence |
| Ab 604 | 1207 | QVQLVQSGAEVKKPGASVKVSCKASGYTFISYGISWVRQAPGQGPEWMGWISTH NGNTNYAQKLQGRVTMTDTSTSTAYMELRSLRSDDTAVYYCARDERSIAVEVYLG STFDIWGQGTMVTVSS | ADI-41286 | Heavy chain variable region ("HC") amino acid sequence |
| Ab 604 | 1208 | DIQVTQSPSSVSASVGDRVTITCRASQGISSMLAWYQQKPGKAPKLLIYAASTLQSG VPSRFSGSGSGTDFTLTISRLQPEDFATYYCQQANIFGVIFGPGTKVDIK | ADI-41286 | Light chain variable region ("LC") amino acid sequence |
| Ab 605 | 1209 | EVQLVESGGGLVQPGRSLRLSCAASGFTFDDYAMHWVRQAPGKGLEWVSSISWH SADIGYAASVEGRFTISRDNAKNSLFLQMNSLRPEDTALYYCAKEIVSTSWYSGYFQ DWGQGTLVTVSS | ADI-41287 | Heavy chain variable region ("HC") amino acid sequence |
| Ab 605 | 1210 | QPVLTQPRSVSGSPGQSVTISCTGTSSDVGVDYNYVSWYQQHPGKAPKLMIYDVSK RPSGVPDRFSGSKSGNTASLTISGLQGEDEADYYCCSYAGRHTFVFGTATKVTVL | ADI-41287 | Light chain variable region ("LC") amino acid sequence |
| Ab 606 | 1211 | EVQLVESGGGLVQPGGSLRLSCAASGFTFSSYAMSWVRQAAGKGLEWVSAISGSG DDTFYADSVKDRFIISRDSSKRKKVYLQMNSLRVEDTAVYYCAKTDIMVTFGGVVVD AYYFDHWGQGTLVTVSS | ADI-41288 | Heavy chain variable region ("HC") amino acid sequence |
| Ab 606 | 1212 | ETTLIQSPGILSLSPGERATLSCRASQFVFRSYLAWYQQRPGQPPRLLIYGASSRATG IPDRFSGRGSGTEFTLTISRLEPEDFAMYYCQHYDSSPPGTFGGGTKVEIK | ADI-41288 | Light chain variable region ("LC") amino acid sequence |
| Ab 607 | 1213 | EVQLVQSGAEVKKPGESLKISCKGSGYSFSSFWIGWVRQMPGKGLEWMGIIYPGD SDTRYSPSFQGQVTISADQSIRTAYLQWNSLKASDTGLYYCAKGLGDVEMATIAV WGQGTLVTVSS | ADI-41289 | Heavy chain variable region ("HC") amino acid sequence |
| Ab 607 | 1214 | QSVLIQPASVSGSPGQSITIPCTGTSSDVGSYNLVSWYQHHPGKAPKLLIISEGSKRPL GVSNRFSGSKSGNTASLTISGLQAEDEADYYCSSYVRSRTFNYVFGTGTKLTVL | ADI-41289 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 608 | 1215 | QVQLQQWGAGLLKPSETLSLTCVVYGESFSDSGYYNTWIRQPPEKGLEWIGEINH GGSTSYNPSLKSRVTISVDTSNQFSLKVTSVTGADTAVYYCARLRLGCSGSCYSRF DYWGQGTLVTVSS | ADI-41291 | Heavy chain variable region ("HC") amino acid sequence |
| Ab 608 | 1216 | DIQLTQSPSSLSASVGDRVTITCRASQSINSYLNWYQQKPGKAPVLLIHAASSLQGG VPSRFSGSGSGTDFTLTISSLQPEDFATYYCQQSYNTRWTFGHGTKVDIK | ADI-41291 | Light chain variable region ("LC") amino acid sequence |
| Ab 609 | 1217 | EVQLLESGGGVVQPGRSLRLSCAASGFSFSSYGIHWVRQAPGKGLECVALMSYDGS EKYYADSVKGRPTISRDNSKNTLYLHMNSLRREDTAVYYCAKGSHLRWSHLDYYFHL WGRGTLVTVSS | ADI-41292 | Heavy chain variable region ("HC") amino acid sequence |
| Ab 609 | 1218 | DIVMTQSPSTLSASVGDRVTITCRASQSLSTWLAWYQQKPGKAPKLLISDASNLESG VPSRFSGRGSGTEFTLTISGLQPDDFATYYCQQERTFGQGTKVDIK | ADI-41292 | Light chain variable region ("LC") amino acid sequence |
| Ab 610 | 1219 | QVQLQQSGPGLAKPSQTLSLTCTVSGGPISGVDYYNSWIRQPPGKGLEWIGYIYYS GSTYNPSLKSRVTISVDTSKKQFSLKMSSVTAADTAVYYCARDVGATPYYYGMD VWGQGTTVTVSS | ADI-41293 | Heavy chain variable region ("HC") amino acid sequence |
| Ab 610 | 1220 | DIVLTQSPDTLSLSPGERATLSCRASQSVRSNYLAWYQHKPGQAPRLLIYGASSRVA GIPDRFSGSGSGTDFTLTISRLEPEDFAVYYCQQYGSSPPSVTFGGGTKVEIK | ADI-41293 | Light chain variable region ("LC") amino acid sequence |
| Ab 611 | 1221 | EVQLLESGGGLVQPGGSLRLSCAASGFTFSAYEMMWVRQAPGKGLEWVSYISSSG SNKHYADSVKGRFTISRDNAKNSLHLHMNSLRAEDTALYYCTRPHQEEWELLPNDA FDLWGQGTMVTVSS | ADI-41294 | Heavy chain variable region ("HC") amino acid sequence |
| Ab 611 | 1222 | QSALTQPPSASGSPGQSVTISCTGTSTDVGAYTYVSWYQQHPGKAPKLIIYEVYKRP SGVPNRFPGSKSGNTASLTVSGLQAEDEADYYCSSYGGSNNFGLFGGGTKLIVL | ADI-41294 | Light chain variable region ("LC") amino acid sequence |
| Ab 612 | 1223 | EVQLVESGVEVKKPGESLKISCRGSGYTFYNYWIAWVRQKPGKGLEYMGTIYLDDS ETIYSPSFQGEVTISADKSINTAYLQWNSLKASDTANYYCARQMDFYFDVWGRGTL VTVSS | ADI-41296 | Heavy chain variable region ("HC") amino acid sequence |
| Ab 612 | 1224 | SYELMQPPSVSVSPGQTARITCSGDPLPRESAYWYQQKPGQTARTFVFGTGTKLTVL PERFSGSRSGTTVTLTISGAQAEDEADYYCQSADSRKTFVFGTGTKLTVL | ADI-41296 | Light chain variable region ("LC") amino acid sequence |
| Ab 613 | 1225 | QVQLVQSGAEVKKPGSSVKVSCKASGGTFSTDAISWVRQAPGQGLEWMGGIIPLF GTANYAQKFQGRVTITADESTSTAYMELNSLRSVDTAVYYCGRTGAFDGEVVVRP HLDLWGQGTLVTVSS | ADI-41297 | Heavy chain variable region ("HC") amino acid sequence |
| Ab 613 | 1226 | QPVLTQPASVSGSPGQSITISCTGTSSDVGGYDYVSWYQHPGKAPKLMIYEVSNR PSGVSNRFSGSKSGNTASLTISGLQADDEAAYYCSSYTRSNTLLFGGGTKLTVL | ADI-41297 | Light chain variable region ("LC") amino acid sequence |
| Ab 614 | 1227 | EVQLVESGGGLVHPGRSLRLSCGAASGFTFRSFAMHWVRQAPGKGLEWVAVISYD GSDEYYADSVKGRFTISRDNSRNTLFLQMNRLRPEDTAIYYCARAYCSTSNCPVLDY WGQGTLVTVSS | ADI-41299 | Heavy chain variable region ("HC") amino acid sequence |
| Ab 614 | 1228 | QSVLIQPASVSGSPGQSITISCTGTSSDVGGYSLVSWYQQHPGKAPKLIIFEGNKRPA GVSDRFSGSKYGDTASLTISGLQAEDEADYYCCSYAGGHSVFGGGTVTVL | ADI-41299 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 615 | 1229 | QVQLVESGGGVVQPGRSLRLSCAASGFTFSSYAMQWVRQAPGKGLEWVAVMTN DGDDKYYADSVRGRFTISRDNSKNTLYLQMNNLRPEDTAVYYCARDLFEWWELLG YCYAMDVWGQGTTVTVSS | ADI-41302 | Heavy chain variable region ("HC") amino acid sequence |
| Ab 615 | 1230 | QSVLTQPPSASGSPGQSVTISCTGTSSDVGAYNYVSWYQQHPGKAPKLIIYEVYKRP SGVPDRRFGSKSGNTASLTVSGLQAEDEADYYCSSYAGSNTLGVFGGGTKVTVL | ADI-41302 | Light chain variable region ("LC") amino acid sequence |
| Ab 616 | 1231 | QVQLVESGGGLVRPGGSLRVSCAASGFIFNNYALTWRQAPGKGLEMVSALSGSG SSTYYADSVKGRFTISRENSNNRLYLQLSGLRAEDTAVYFCARVRGLVWFGRIDPY PNVFDYWGQGTLVTVSS | ADI-41303 | Heavy chain variable region ("HC") amino acid sequence |
| Ab 616 | 1232 | DIVLTQSPGTLSLSPGERATLSCRASQSVSNDYLAWYQQKPGQAPRLLIYDASSRAI GIPDRFSGSGSGTDFTLIISRLEPEDFAVYYCHHPGKFGQGTKVEIK | ADI-41303 | Light chain variable region ("LC") amino acid sequence |
| Ab 617 | 1233 | EVQLVESGPGLVKPSQTLSLTCTVSGGSIRSHDYYWSWIRQPPGKGLEWIGYISYSG STYYNPSLKSRVIISLDTSKNQFSLNLTSVTAADTAMYYCARDRPHTSSWIPGWFDP WGQGTLVTVSS | ADI-41304 | Heavy chain variable region ("HC") amino acid sequence |
| Ab 617 | 1234 | SYELTQPPSASGTPGQRVTISCSGSSSNIGSNTVSWYQQPPGKAPKLLIYSNNERPSG GPDRFSGSKSGTSASLAIGGLQSEDEANYYCAAWDDSLYAVVFGGGTKLTVL | ADI-41304 | Light chain variable region ("LC") amino acid sequence |
| Ab 618 | 1235 | QVTLKESGPGLVKPSQTLSLLCTVSGGSISGGYYMSWIRQLPGKGLQWIGCIYDS GTTYYNPSLKSLVTISIDTSKNQFSLKLSSVTAADTAVYYCARGGSLDDFWSATWYFA LWGRGTLVTVSS | ADI-41305 | Heavy chain variable region ("HC") amino acid sequence |
| Ab 618 | 1236 | EIVLTQSPGTLSLSPGERATLSCRASQSVSSNYLAWYQQKPGQAPRLLIYGASSRATG IPDRFSGSGSGTDFTLTISRLEPEDFAFYYCQQYGRSPYIFGPGTKLEIK | ADI-41305 | Light chain variable region ("LC") amino acid sequence |
| Ab 619 | 1237 | QVQLVESGPRLVKPSQTLSLICTVSGGSIYRGDYDMNWIRQPPGKGLEWIGYISYT GNTHYNSSLKSRLSISADTSGTHFSLKLSSVTAADTAIYYCARDVGYGGNAAHYYYA MDVWGQGTTVTVSS | ADI-41306 | Heavy chain variable region ("HC") amino acid sequence |
| Ab 619 | 1238 | ETTLTQSPATLSLSPGERATLSCRASQSVGSSLAWYQQKVGQAPRLLIYDASSRVTGI PARFSGSGSGTDFTLTISSLEPGDFAVYYCQQRSNLTFGGGTKVIK | ADI-41306 | Light chain variable region ("LC") amino acid sequence |
| Ab 620 | 1239 | QVQLVESGGGLVKPGGSLRLSCAASGFPLSPYALNWVRQAPGKGLEWVSSITSSSA YIYYADSVKGRFTVSRDNPTNSLYLQMNSLRAEDTAVYYCARTIPQHYYDNNGDYY NYGMDVWGQGTTVTVSS | ADI-41307 | Heavy chain variable region ("HC") amino acid sequence |
| Ab 620 | 1240 | DIVLTQSPATLSVSPQGRITLSCRASQTVRSNLAWYQQKPGQQPPRLLIYGASTRATG VPARFTGSGSGTEFTLTITSLQSDDFAVYYCHQYNDRPLTFGPGTKVEIK | ADI-41307 | Light chain variable region ("LC") amino acid sequence |
| Ab 621 | 1241 | EVQLVESGPGLVKPSQTLSLTCAISGDSVSSNSAAWNWIRQSPSRGLERMGRTYYR SKWYDDYAVSVKSRIIINPDTSKNQFSLQLNSVTPEDTAVYYCARGLSTFGGVIYALEI WGQGTMVTVSS | ADI-41308 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 621 | 1242 | SYVLTQPASVSGSPGQSITISCTGLTSDVGGYNFVSWYQQHPGKAPKLIIYDVSHRPS GVSNRFSGSESNTASLTISGLQAEDEAHYCSSYTRTSIVVFGGGTKLTVL | ADI-41308 | Light chain variable region ("LC") amino acid sequence |
| Ab 622 | 1243 | EVQLLESGPGLVKPSQTLSLTCTVSGGSISSGDYYWSWVRQPPGKGLEWIGNIYHS GSTYYKPSLKSRVSISLDTSKNQFSLKLSSVTAADTAIYYCARDGGENYVWGTFRFLD VWGQGTTVTVSS | ADI-41309 | Heavy chain variable region ("HC") amino acid sequence |
| Ab 622 | 1244 | DIRLTQSPGILSLSPGERATLSCRASQSVSSSYLAWYQQKPGQAPRLLIYGVSSRATG IPDRFSGSGSGTDFTLTINRLEPEDFALYHCQQYGSSPHITFGQGTKVEIK | ADI-41309 | Light chain variable region ("LC") amino acid sequence |
| Ab 623 | 1245 | QVQLVQSGVEVKKPGESLKISCRGSGYSFYNYWIAWVRQKPGKGLEYMGTIYLDDS DTIYSPSFQGEVTISADKSINTAYLQWNSLKASDTANYYCARQMDFYFDVWGRGTL VTVSS | ADI-41310 | Heavy chain variable region ("HC") amino acid sequence |
| Ab 623 | 1246 | SYELTQPPSVSVSPGQTARITCSGDPLPRESAYWYQQKPGQAPVVVIFNDIERPLGI PGRFSGSRSGATATLTINGAQAEDEADYCQSADSRKTFVFGAGTKLTVL | ADI-41311 | Light chain variable region ("LC") amino acid sequence |
| Ab 624 | 1247 | QVTLKQSGPALVKPTQTLTLTCTFSGFSLSTKRMGVSWIRQPPGKALEWLARIDWD DDKYYSTSLRTRLTISKDTSKNQVVLTMTDMDPVDTATYYCARIQPYTSGGYYSYYF DYWGQGTLVTVSS | ADI-41311 | Heavy chain variable region ("HC") amino acid sequence |
| Ab 624 | 1248 | DIQVTQSPSSLSASIGDRVTITCRASQTIASYLNWYQQKPGKAPKLLIYIASSLQSGVP SRFSGSGSGTDFTLTISTLQPEDFATYYCQQSYGTPWTFGQQTKVEIK | ADI-41312 | Light chain variable region ("LC") amino acid sequence |
| Ab 625 | 1249 | QVQLQESGPGLVKPSGTLSLTCAVSGGSISSSNWMNWVRQPPGKGLEWIGEIYHS GRTNYNMPSLKSRVSISIDKFKSQFSLNLNSVTAADTAVYYCARDLPGTPYDIVPGYYP GLRRHDAFDIWGQGTMVTVSS | ADI-41312 | Heavy chain variable region ("HC") amino acid sequence |
| Ab 625 | 1250 | QSVLTQPPSASGTPGQRVTMSCSGSSSNIGSDTVNWYQQLPGTAPKLLIYSNNQR PSGVPDRFSGSKSGTSASLAISGLQSEDEADYYCAAWDDSLNGWVFGGGTKLTVL | ADI-41313 | Light chain variable region ("LC") amino acid sequence |
| Ab 626 | 1251 | EVQLVESGAEVKKPGASVKVSCKASGYTFNNYDISWVRQAPGQGLEWMGWISTY NGNTNYAQKFQGRATMTDTSTTTAYMELRSLRSDDSAIYYCARVYCGGDCHNPF FLYFDLWGRGTLVTVSS | ADI-41313 | Heavy chain variable region ("HC") amino acid sequence |
| Ab 626 | 1252 | SYVLTQPLSVSVALGQTARITCGGNNIGSKSVHWYQQKPGQAPLLVIYRDNNRPSG IPERFSGSTSGNTATLTISRAQAGDEADYSCQVWDNSDWVFGGGTKLTVL | ADI-41314 | Light chain variable region ("LC") amino acid sequence |
| Ab 627 | 1253 | QVQLVQSGAEVKKPGSSVKVSCKAFGGIFSSYAISWVRQAPGQGLEWMGGIIPIFG TTKYAQKFQGRVTITADKSTSTVYMEVSSLRPEESAVYFCARAYCSGGTWYGGADY WGQGTLVTVSS | ADI-41314 | Heavy chain variable region ("HC") amino acid sequence |
| Ab 627 | 1254 | QSVLTQPPSVSVSPGQTARITCSGDVLPKQYAYWYQQKPGQAPLLVMYKDTERPS GIPERFSGSSSVTAVLTISGVQAEDEADYCQSADSTQELFGGGTKLTVL | ADI-41315 | Light chain variable region ("LC") amino acid sequence |
| Ab 628 | 1255 | EVQLLESGPGLVKPSETLSLTCAVSGGSISNYYWSWIRQPPGKGLEMIAYISYSGTTN YNPSLESRVTISVDTSKNQFSLKLNSVTAADTAVYYCARHEFLVLPDVWGQGTLVTV SS | ADI-41315 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 628 | 1256 | ETTLIQSPGILSLSPGERATLSCRASQSVSSTFLAWYQQKPGQAPRLLIYAASSRATGIPDRFSGSGSGTDFTLTISRLEPEDFAVYYCQQYRSSPFSFGPGTKVEIK | ADI-41315 | Light chain variable region ("LC") amino acid sequence |
| Ab 629 | 1257 | QVQLVQSGGGVVQPGRSLRLSCAASGFTENNYGMHWVRQAPGKGLEWVAVLSFDGINKYYADSARGRFTISRDNSKNTLYLQMNSLRAEDTALYYCAKDRQEYSSGWTHDACDIWGQGTMVTVSS | ADI-41316 | Heavy chain variable region ("HC") amino acid sequence |
| Ab 629 | 1258 | EIVMTQSPATLSVSPGERATLSCRASQNVNNNLAWYQQNPGQAPRLLIFGASTRATGIPARFSGSGSGTEFTLTISSLQSEDFAVYYCQQYNNWPRTFGQGTKLEIK | ADI-41316 | Light chain variable region ("LC") amino acid sequence |
| Ab 630 | 1259 | EVQLVESGGGLVQPGGSLRLSCEASRPKFSTFWMAWVRQAPGKGLEWVANIKQDGSETYYLDSVKGRFTISRDNAKNSLFLQMKSLRAEDTAVYYCAGLWWGDLENWFDPWGQGTLVTVSS | ADI-41317 | Heavy chain variable region ("HC") amino acid sequence |
| Ab 630 | 1260 | QSVLTQPPSVSGAPGQRVTISCTGSSSNLGTGFDVHWYRQLPGTAPQLLIYGSTNRPSGVPDRFSGSKYGTSASLAITGLQAEDEADYYCQSYDSNLRAYVPGTVTKVTVL | ADI-41317 | Light chain variable region ("LC") amino acid sequence |
| Ab 631 | 1261 | EVQLLESGAEVKKPGSSVRVSCKAFGGTFSSYAFSWVRQAPGQGLEWMGGIIPMFGTENYAPNFQGRVTITADKLTTTVMELSRLRSEDSAVYYCAREGGRLGTTMGAFDMWGQGTMVTVSS | ADI-41318 | Heavy chain variable region ("HC") amino acid sequence |
| Ab 631 | 1262 | DIRLTQSPSSLSASVGDRVTITCRASHGISSALAWYQQRPGKRVPQVLIFHASTLESGVPSRFSGSGSGTDFTLTISSLQPEDFATYYCQQFNSYPYTFGQGTKVEIK | ADI-41318 | Light chain variable region ("LC") amino acid sequence |
| Ab 632 | 1263 | QVQLQESGPGLVKPSQTLSLTCTVSGGSISSGDYYWSWIRQPPGKGLEWICGYIFYSGTTYYNPSLKSRVTISLDTSQNQFSLKLSSVTAADTAVYYCARDGDEVDYVWGTRRYLDSWGRGTLVTVSS | ADI-41319 | Heavy chain variable region ("HC") amino acid sequence |
| Ab 632 | 1264 | EIVLTQSPGTLSLSPGERATLSCRASQSVSSRYLAWYQQKPGQAPRLLIHGASSRATGIPDRFSGSGSGTDFTLTISRLEPEDFAVYYCLQYGSLPKTFGQGTKVEIK | ADI-41319 | Light chain variable region ("LC") amino acid sequence |
| Ab 633 | 1265 | QVQLVQSGVEVKKPGESLKISCRGFGYSAYNYWIAWVRQKPGKGLEYMGTIYLDDSDTIYSPSFQGEVTISADRSINTAYLQWNSLKASDTANYYCARQMDFYFDVWGRGTLVTVSS | ADI-41320 | Heavy chain variable region ("HC") amino acid sequence |
| Ab 633 | 1266 | QSVLTQPPSVSVSPGQTARITCSGDPLPRESAYWYQQKPGQAPVVVIFNDIERPLGIPARFSGSRSGTTVTLTISGAQAEDEADYYCQSADSRKTFVFGPGTKLTVL | ADI-41320 | Light chain variable region ("LC") amino acid sequence |
| Ab 634 | 1267 | QVQLVQSGAEVKKPGSSVRVSCKASGGFSSYATSWVRQAPGQGLEWMGGIIPMYDAVNYAQKFQGRVTITADESTTTAVMELSSLRSEDTAVYYCARSSGYTGINFFDYWGQGTLVTVSS | ADI-41322 | Heavy chain variable region ("HC") amino acid sequence |
| Ab 634 | 1268 | DIQMTQSPSSVSASVGDRVTITCRASQDISSMLAWYQQKPGKAPKLLIYTASSLQSGVPSRFSGSGSGTDFTLTISRLQPEDFATYYCQQANSFPRVTFGGGTKVEIK | ADI-41322 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 635 | 1269 | EVQLLESGGGVRPGGSLRLCAASGFTFDDYAMGWVRQAPGKGLEWVSGITW NAGSTAYAGSVKGRFTISRDNAKNSLFLQMNSLRAEDTAFYLCARHVDSSGPVARH FDYWGQGTLVTVSS | ADI-41323 | Heavy chain variable region ("HC") amino acid sequence |
| Ab 635 | 1270 | NFMLTQPHSVSESPGKTVTISCTRSSGSIARNYVQWYQQRPGSAPTIVIYEDNQRPS GVPDRFSGSIDSSSNSALTISGLKTEDEADYYCQSYDPSNVFGGGTKLTVL | ADI-41323 | Light chain variable region ("LC") amino acid sequence |
| Ab 636 | 1271 | EVQLVESGGGLVQPGGSLRLSCAASGFTVSNNYMRWVRQAPGKGLEWVSIYSS GSTDYADSVKGRFTISRDNSKNTLYLQMNSLRAEDTAVYYCARERTLFYDSSGFFD YWGQGTLVTVSS | ADI-41324 | Heavy chain variable region ("HC") amino acid sequence |
| Ab 636 | 1272 | ETTLTQSPGTLSLSPGERATLSCRASQSVDSSYLAWYQQKPGQAPRLLIYGASNRAT GIPDRFSGSGSGTDFTLTISRLEPEDFAVYYCQQYGRSLITFGGGTKLEIK | ADI-41324 | Light chain variable region ("LC") amino acid sequence |
| Ab 637 | 1273 | QVQLVQSGAEVKTPGSSVKVSCKASGGTFRSYPITWVRQAPGQGLEWMGTVIPVF DTVNYAPKFQGRVSITADESTNTAYMELSSLRSDDSAVYYCARDLGWLRPMTTVTS PHFDYWGQGTLVTVSS | ADI-41340 | Heavy chain variable region ("HC") amino acid sequence |
| Ab 637 | 1274 | QSVLTQPASVSGSPGQSITISCTGTSSDVGGYDFVSWYQQHPGKAPKLMISEVTDR PSGVSNRFSGSKSGNTASLTISGLQAEDEADYYCTSYTSSRTYVFGTGTKLTVL | ADI-41340 | Light chain variable region ("LC") amino acid sequence |
| Ab 638 | 1275 | QVQLVQSGAEVKKPGSSVKVSCKASGGTFSSYATHWVRQAPGQGLEWMGGIIPIF GRATYAQKFQGRVTISADESTSTAYMELSSLRSEDTAVYYCARGRDDRSGDHIAFLY HYGMDVWGQGSTVTVSS | ADI-41341 | Heavy chain variable region ("HC") amino acid sequence |
| Ab 638 | 1276 | QSVLTQPPSVSVSAAPGQKVSISCSGSSSNIGINHASWYQHLPGTAPKLLIYDNNKRPS GIPDRFSGSKSGTSATLGISGLQTGDEAAYYCGTWDTGLSAVVFGGGTKLTVL | ADI-41341 | Light chain variable region ("LC") amino acid sequence |
| Ab 639 | 1277 | QVQLVQSGAEVKKPGSSVKVSCKASGGTLITSYGVSWVRQAPGQGLEWMGGIIPIF GTVDYAQKFQGRVTITADEPTSTAYMELSSLTSDDTAVYYCARDPWVSGPVEFYYY FDVWGRGTLVTVSS | ADI-41342 | Heavy chain variable region ("HC") amino acid sequence |
| Ab 639 | 1278 | DIVLTESPATLSLSPGERATLSCRASQSINNRYLAWYQQKPGQAPRLLIFGASSRATG IPDRFSGSGSGTDFTLTISRLEPEDFAVYYCQQYGSTPPFTFGQGTKVEIK | ADI-41342 | Light chain variable region ("LC") amino acid sequence |
| Ab 640 | 1279 | EVQLVESGGGLVKPGGSLRLSCAASGFTFSSYYMNWVRQAPGKGLEWVSSIGGS SYISYADSVKGRFTISRDNAKNSLYLQMNSLRAEDTAVYYCARVDTPMVRGYYFDY WGQGTLVTVSS | ADI-41343 | Heavy chain variable region ("HC") amino acid sequence |
| Ab 640 | 1280 | QSVLTQPPSVSGAPGRRVTISCTGSSNIGAGYDVHWYQQLPGTAPKLLIFANSNRP SGVPDRFSGSKSGTSASLAITGLQAEDEADYYCQSYDSSLSGSVFGGGTKVTVL | ADI-41343 | Light chain variable region ("LC") amino acid sequence |
| Ab 641 | 1281 | EVQLVESGGGLVKPGGSLRLSCAASGFTFSSYYMNWVRQAPGKGLEWVSSISSSST YIDYADSVKGRFTISRDNAKNSLFLQMNSLRAEDTAVYYCARVSSPMIRGYLDYW GQGTLVTVSS | ADI-41344 | Heavy chain variable region ("HC") amino acid sequence |
| Ab 641 | 1282 | QPVLTQPPSVSGAPGQRVTISCTGSSSNIGAGYDVHWYQQLPGTAPKLIVHGNSN RPSGVPDRFSGGKSGTSASLAITGLQEEDEADYYCQSYDSSLSGSVFGGGTKLTVL | ADI-41344 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 642 | 1283 | EVQLVQSGAEVRKPGESLKISCKGSGYNFASYWIAWVRQMPGKGLEWMGIIFPGD SDTRYSPSFQQVTISVDKSISTAYLQWSSLKASDTAIYYCATSKYTFGYLDWGQGTL VTVSS | ADI-41345 | Heavy chain variable region ("HC") amino acid sequence |
| Ab 642 | 1284 | NFMLTQPHSVSESPGKTVTISCTRSSGSIASNYVQNYQQRPGSAPTTVIYEDNQRP SGVPDRFSGSIDSSSNSASLTISGLKTEDEADYYCQSYDTSNQVFGTGTKVTVL | ADI-41345 | Light chain variable region ("LC") amino acid sequence |
| Ab 643 | 1285 | QVQLVQSGPEVKKPGESLKISCTLSASGLTTYWIGWVRQMPAKGLEWMGIIFPGD SDTRYSPSFQQVTISADKSTNTAYLQWSGLKASDTAIYYCATLQTPVTGLDQWGQ GTLVTVSS | ADI-41346 | Heavy chain variable region ("HC") amino acid sequence |
| Ab 643 | 1286 | NFMLTQPHSVSESPGKTVTISCTRSSGNIARSYVQNYQQRPGSAPTTVIHEDDQRP SGVPDRFSGSIDTSSNSASLTISGLKTEDEADYYCQSYDPSNYVFGTGTKVTVL | ADI-41346 | Light chain variable region ("LC") amino acid sequence |
| Ab 644 | 1287 | EVQLVESGPGLVKPSGTLSLTCAVSGGSVSSDNWMSWVRQPPGKGLEWIGEIYPS GGTNYNPSLNSRVTISVDKSKNQFSLKLNSVTAADTAIYYCARAPFDSSGYHSNSVW GQGTLVTVSS | ADI-41347 | Heavy chain variable region ("HC") amino acid sequence |
| Ab 644 | 1288 | ETTLTQSPLSLPVTPGEPASISCRSSQSLLHSNGHNYLDWYLQKPGQSPQLLIYLSSN RASGVPDRFSGSGSGTDFTLRISRVEAEDVGVYYCMQPLQTPQTFGQGTKVEIK | ADI-41347 | Light chain variable region ("LC") amino acid sequence |
| Ab 645 | 1289 | QVQLQESGPGLVKPSQTLSLTCAVSGGSISSGGYWNWIRQHPGKGLEWIGYIYYS GSTYNPSLKSPVTISVDTSKNQFSLKLTSVTAADTAVYYCARGDYFDGSGRTTAAF DIWGQGTMVTVSS | ADI-41348 | Heavy chain variable region ("HC") amino acid sequence |
| Ab 645 | 1290 | DIQVTQSPSSLSASVGDRVTITCRASQSISTFLNWYQQKPGRAPKLLIYDASNLQSGV PSRVSGSGSGTDFTLTISSLHPEDFATYYCQQSYTTPYTFGQGTKVDIK | ADI-41348 | Light chain variable region ("LC") amino acid sequence |
| Ab 646 | 1291 | EVQLLESGGGLVQPGRSLRLSCTGSGFTFGDYAMNWVRQAPGKGLEWVGLIRSKD YGGTTEFAASLKGRLTISRDDSKSIAYLQMHSLKTEDSAVYYCTRAHLTDYTDINGYQ YYFDYWGQGSPVTVSS | ADI-41349 | Heavy chain variable region ("HC") amino acid sequence |
| Ab 646 | 1292 | DIQMTQSPSSLSASVGDRVTITCQASQDISNFLNWYQQRPGKAPKLLIHDASNLET GVPSRFSGSGSRTEFTFTISSLQPEDIGTYYCQHYDNFPYTFGQGTKVEIK | ADI-41349 | Light chain variable region ("LC") amino acid sequence |
| Ab 647 | 1293 | EVQLVESGAGLVQPGGSLRLSCAASGFTFSTYAVSWVRQAPGKGLEWVSAISGSG ASTYFADSVKGRFTISRDNSKNTLYLQMNSLRAEDTAVYYCAKARLELRPYYYGMD VWGQGTTVTVSS | ADI-41350 | Heavy chain variable region ("HC") amino acid sequence |
| Ab 647 | 1294 | QPVLTQPASVSGSPGQSITISCTGTSSDVGGYNFVSWYQQHPGKAPKLIIYEVSNRP SGVSNRPSGSKSGNTASLTISGLQAEDEADYYCSSSTLSTYVFGTGTKVTVL | ADI-41350 | Light chain variable region ("LC") amino acid sequence |
| Ab 648 | 1295 | QVQLVQSGGGLVQPGGSLRLSCSASGFTFSSKSMHWVRQAPGKGLEYVSAIRSDG VSTYYGDSVKGRFTVSRDNAKNTVLRMSSLRREDTAVYYCVKGPYGDFQYNWFD TWGQGTLVTVSS | ADI-41351 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 648 | 1296 | ETTLIQSPATLSVSPGERATLSCRASQSVSSNLAWYQQKPGQAPRLLIYGASIRATGI PARFSGSGSGTEFTLTISSLQSEDFAVYYCQQYDNMPPGDTFGQGTKVEIK | ADI-41351 | Light chain variable region ("LC") amino acid sequence |
| Ab 649 | 1297 | EVQLVESGGGLVQPGGSLRLSCAASGFTFSSYRMNWVRQAPGKGLEWVSYIDISSS TIYYADSVKGRFTISRDNAKNSLYLQMNSLRAEDTAVYYCARDQLVWEPLIRNHYYY AMDVWGQGTTVTVSS | ADI-41352 | Heavy chain variable region ("HC") amino acid sequence |
| Ab 649 | 1298 | EIVMTQSPDSLAVSLGERATINCKSSQSVLYSSNNKNYLAWYQQKPGQPPKLLIYW ASTRESVPDRPSGSGSGTDFTLTISSLQAEDVAVYYCQQYYSSPPTFGQGTKVEIK | ADI-41352 | Light chain variable region ("LC") amino acid sequence |
| Ab 650 | 1299 | EVQLVESGGVEVKKPGESLKISCRGSGYSFHNYWIAWVRQKPGKGLEYMGTIYVDDS DTIYSPSFQGEVTISADKSINTAYLQWNSLKASDTANYYCARQMDFYFDVWGRGTL VTVSS | ADI-41353 | Heavy chain variable region ("HC") amino acid sequence |
| Ab 650 | 1300 | SYELTQPPSVSVSPGQTARITCSGDPLPRESAYWYQQKPGQAPVVVIFNDIERPLGI PERFSGSRSGTTVTLTISGAQAEDEADYYCQSADSRKTFVFGSGTKLTVL | ADI-41353 | Light chain variable region ("LC") amino acid sequence |
| Ab 651 | 1301 | EVQLLESGGGLVQPGGSLRLSCAASGFTFSSYAMSWVRQAPGKGLEWVSGISGSG GTTYYADSVKGRFTISRDNSKNTLYLQMNSLRAEDTAVYYCAKDSPVNINCGGDCD VAYWGQGTLVTVSS | ADI-41354 | Heavy chain variable region ("HC") amino acid sequence |
| Ab 651 | 1302 | EIVMTQSPSSLSASVGDTVTITCQASQDISYSLNWYQQKPGKAPNLLIFDASHLQTG VPSRFSGSGGGDKHFSFTISSLQPEDVATYYCQQYDSLMYTFGQGTKVEIK | ADI-41354 | Light chain variable region ("LC") amino acid sequence |
| Ab 652 | 1303 | EVQLVESGGGLVKPGGSLRLSCTASGFTFSDYYMNWIRQAPGKGLEWVSYISGDG NTIYYTDSVKGRFTISRDNAKNSLFLQMNSLRGEDSAVYYCAGPVRGYTYGIFDYW GQGALVTVSS | ADI-41355 | Heavy chain variable region ("HC") amino acid sequence |
| Ab 652 | 1304 | YYVLTQPPSVSVAPGQAARITCGGNNIGSRSVNWYQQKPGQAPVVVIYGDSVRPS GIPERFSGSGSNGNTATLTFSRVEAGDEADYYCQVWETNSDHPVVFGGGTKVTVL | ADI-41355 | Light chain variable region ("LC") amino acid sequence |
| Ab 653 | 1305 | QVQLVQSGAEVKKPGASVKVSCKASGYTFTNYDINWVRQATGQGLEWMGWMN RNNGNTGYARKFQGRVTMTRNTSISTAYMELSSLRSEDTAVYYCARGGDFYAMDV WGQGTTVTVSS | ADI-41356 | Heavy chain variable region ("HC") amino acid sequence |
| Ab 653 | 1306 | SYELTQPPSVSVSPGQTASITCSGDKLGDKYASWYQQKPGQSPVLVIYQDTKRPSG VPERFSGSNSGNTATLTISGTQAVDEADYYCQVWDGSIAPGGGTKVTVL | ADI-41356 | Light chain variable region ("LC") amino acid sequence |
| Ab 654 | 1307 | EVQLVESGGGLVQPGGSLRLSCAASGFTFSTYGMNWVRQAPGKGLEWVSYIGGS GRIIYYADSVKGRFTISRDNAKNSLYLQMNSLRAEDTAVYYCARDQHIVLVTGSTPD YWGQGTLVTVSS | ADI-41357 | Heavy chain variable region ("HC") amino acid sequence |
| Ab 654 | 1308 | EIVLTQSPSSLSASVGDRVTITCRASHAISNYLAWFQQKPGKAPKSLIYAASTLQSGV PSKFSGSGSGTDFTLTISSLQPEDFATYYCQQYSSYPLTFGGGTKVEIK | ADI-41357 | Light chain variable region ("LC") amino acid sequence |
| Ab 655 | 1309 | EVQLVESGGGLVKPGGSLRLSCEASGFTLTSYSMNWVRQAPGKGLEWVSSISSSST YIHYADSVKGRFTISRDNAKNSLYLQMNSLRAEDTAVYYCARDKVMTKYNGMDV WGQGTTVTVSS | ADI-41358 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 655 | 1310 | QSVLTQPPAVSGAPGQRVTISCTGSSSNIGAGHDVHWYQQLPGTAPKLLIYGNSNR PSGVPDRFSGSKSGTSASLAITGLQAGDEADYYCQSYDSSLSGSLFGGGTKLTVL | ADI-41358 | Light chain variable region ("LC") amino acid sequence |
| Ab 656 | 1311 | EVQLVESGGGLVKPGGSLRLSCAASGFTISGYSMDWVRQAPGKGLEWVSSISSSSS YIHYADSVKGRFTISRDNAKNSLYLQMNSLRAEDTAVYYCATNPREGGAFDIWGQ GTTVTVSS | ADI-41359 | Heavy chain variable region ("HC") amino acid sequence |
| Ab 656 | 1312 | QSVLTQPPSMSGAPGQRVTISCTGSSSNIGAGYDVHWYQQLPGTAPKLLIYNNSNR PSGVPDRFSASKSGTSASLAITGLQAEDEADYYCQSYDSSLSGYVPGTGRVTVP | ADI-41359 | Light chain variable region ("LC") amino acid sequence |
| Ab 657 | 1313 | EVQLVESGGGLVQPGGSLRLSCAASGLTFSRYSMNWVRQAPGKGLEWVSYISSTG RRIQYADSVKGRFTISRDDGKNSLYLQMNSLRAEDTAVYYCARDPLNYHDNTAYW SYWGQGTLVTVSS | ADI-41360 | Heavy chain variable region ("HC") amino acid sequence |
| Ab 657 | 1314 | NFMLTQPHSVSESPGKTVTISCTRSSGSIASNYVQWYQQRPGSAPTTVIYEDNQRP SGVPDRFSGSIDSSSNSASLTISGLKTEDEADYYCQSYDSSNPLVFGGGTKLTVL | ADI-41360 | Light chain variable region ("LC") amino acid sequence |
| Ab 658 | 1315 | QVQLQESGGGVVQPGRSLRLSCAASGFTISRDNSENTLFLQMNSLRAEDTAVYYCVRDFVPCSGATCYLP GSNKFYADSVKGRFTISRDNSENTLFLQMNSLRAEDTAVYYCVRDFVPCSGATCYLP PVYWGRGTLVTVSS | ADI-41361 | Heavy chain variable region ("HC") amino acid sequence |
| Ab 658 | 1316 | EIVLTQSPATLSVSPGERATLSCRASQSVSSDLAWYQQKPGQAPRLLIYGASTRATGI PARFSGSGSGTEFTLTISRLQSEDFAVYFCQQYNNWPSWTFGQGTKVEIK | ADI-41361 | Light chain variable region ("LC") amino acid sequence |
| Ab 659 | 1317 | EVQLVESGGGLVQPGGSLRLSCAASGFTFSDHWMNWVRQTPGKGLEWVANIKP DGRETYVDSVKGRFTISRDNSKKSVYLQMNSLRAEDTAVYYCVRDGHIVVTAVP PGFFDLWGRGTLVTVSS | ADI-41362 | Heavy chain variable region ("HC") amino acid sequence |
| Ab 659 | 1318 | DIQVTQSPSSLSASVGDRVTITCQASQDLITKYLNWYQQKPGKAPKLLIYDISNLETG VPSRFSGSGFGTEFTLTISSLQPEDVATYYCQQYQNLPYTFGQGTKVEIK | ADI-41362 | Light chain variable region ("LC") amino acid sequence |
| Ab 660 | 1319 | QVQLVQSGAEVKKPGGSVKVSCKASGGTFSSYAITWVRQAPGQGLEWMGGIIPLF GTAKYAQQFQGRVTITADESTSTAYMELSSLRSEDTAVYYCARDGEVCTNGFCWFL DWGLGTLVTVSS | ADI-41363 | Heavy chain variable region ("HC") amino acid sequence |
| Ab 660 | 1320 | DIRVTQSPSSLSASVGDRVTITCQASQDISNYLNWYQQKPGKAPKLLIYDASKLETG VPSRFSGSGSGTDFTFTISSLQPEDIATYYCQNYGNFPHFGGGTKLEIK | ADI-41363 | Light chain variable region ("LC") amino acid sequence |
| Ab 661 | 1321 | EVQLLESGAEVKKPGASVKVSCKASGYTFTDHSIHWVRQAPGRGLEWMGWFNPH TGVTDYAQKFQGWVTMTSDTSISTAYMELSSLKSDDTAIYFCARDQMETDGAYFL DYWGQGTLVTVSS | ADI-41364 | Heavy chain variable region ("HC") amino acid sequence |
| Ab 661 | 1322 | QSALTQPASVSGSPGQSITISCTGTSSDVGNFKLVSWYQQHPGKAPKLMIYEGNKR PSGVSNRFSGSKSGNTASLTISGLQAEDEADYYCCSSAVSSTFPGTKLTVL | ADI-41364 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 662 | 1323 | EVQLVESGGGLVKPGGSLRLSCATSGFTFSDYYMTWIRQAPGKGLEWVSISSSGG YTNYADSVRGRFTISRDNAKRSLYLQMNSLRAEDTAVYYCARVEFSSGDVSLFDS WGQGTLVTVSS | ADI-41365 | Heavy chain variable region ("HC") amino acid sequence |
| Ab 662 | 1324 | QSVLTQPPSVSGAPGQRVTISCTGSSSNLGAGYHVHWYQQFPGTAPKLIYGNTN RPSGVPDRFSGSKSGTSASLAITGVQAEDEADYYCQSYDYLSGWVFGGGTKLTVL | ADI-41365 | Light chain variable region ("LC") amino acid sequence |
| Ab 663 | 1325 | QVQLVQSGAEVKKPGESLKISCKASGYSSTTYWIGWVRQISGKGLEWMGIIYPGDS DTRYSPSFQGQVTISADRSTKTAYLQWSSLKASDTAMYYCGTSGFVATPDYWG QGTLVTVSS | ADI-41366 | Heavy chain variable region ("HC") amino acid sequence |
| Ab 663 | 1326 | NFMLTQPHSVSESPGKTVTISCTRTSGSIAGNYVHWYQQRPGSAPTTVIYEDNQRP SGVPDRFSGSIDRSSNSASLITISGLKTEDEADYYCQSYASGIHGYVFGGGTKVTL | ADI-41366 | Light chain variable region ("LC") amino acid sequence |
| Ab 664 | 1327 | QVQLVQSGAAVKRPGASVKVSCKASGYTFSTNALHWVRQAPCQSLEWMGWINT DNGIPKYSERFHGRVTFTRDTSASTVYMDLSGLRSGDTAVYYCARDGSSGHWLGLS VLDNWGQGTLVTVSS | ADI-41367 | Heavy chain variable region ("HC") amino acid sequence |
| Ab 664 | 1328 | QSALIQPASVSGSPGQSITISCTGTSDDVGAYNYVSWYQQYPNKAPKLVIYEVSHRP SGVSNRFSGSKSGNTASLTISGLQAEDEADYYCSSYTRSATPYVFGTGTKLTVL | ADI-41367 | Light chain variable region ("LC") amino acid sequence |
| Ab 665 | 1329 | EVQLVESGGGVVQPGRSLRLSCAASGEIFRNYGMHWVRQAPGKGLEWVAGTSFE GRNKDYGHSVKGRFTISRDNSKDTLYLQMNSLRPEDTAVYSCAKGSSLQWSHLDW YFDLWGRGTLVTVSS | ADI-41368 | Heavy chain variable region ("HC") amino acid sequence |
| Ab 665 | 1330 | DIVMTQSPSTLSASVGDRVTITCRASQSFSSWLAWYQQKPGKAPNLLIYDASTLESG VPSRFSGSGSGTEFTLTISSLQPDDFATYYCQQERTFGQGTKVEIK | ADI-41368 | Light chain variable region ("LC") amino acid sequence |
| Ab 666 | 1331 | EVQLVQSGGGVVQPGRSLRLSCAASGFTISSYGMHWVRQAPGKGLEWVAVISHD GNNKYYGDSVKGRFTIISRDNSKNTLHLQMNSLRGDDTAVYYCGKDPLKGDCSGGS CYQRIDYWGQGTLVTVSS | ADI-41369 | Heavy chain variable region ("HC") amino acid sequence |
| Ab 666 | 1332 | NFMLTQPHSVSESPGKTVTISCTGSSGRIASNYVQWYQQRPGSAPATVIYDDNQRP SGVPDRFSGSIDSSSNSASLITISGLKTEDEADYYCQSYDRSNHVIFGGGTKLTVL | ADI-41369 | Light chain variable region ("LC") amino acid sequence |
| Ab 667 | 1333 | EVQLVESGGGLVKPGGSLRLSCAASGFTFSGFSMNWVRQAPCKGLEWVSISSTSR YIYYADSVQGRFTISRDNAKNSLYLQMNSLRAEDTAVYYCARDPGGSASFVPYYYG MDVWGQGATVTVSS | ADI-41370 | Heavy chain variable region ("HC") amino acid sequence |
| Ab 667 | 1334 | SYELIQPPSVSVSPGQTARITCSGDALPNQYVYWYKKPGQAPVLVIYKDTEGPLGI PERFSGSSSGTTVTLTISGVQAEDEADYYCQSADSSGTYPYVVFGGGTKLTVL | ADI-41370 | Light chain variable region ("LC") amino acid sequence |
| Ab 668 | 1335 | QVQLQESGPRLVKPSQTLSLTCTVSGGSITTGEHYWSWIRQSPGRGLEWICYISYSG STYYNPSLKSRVTISVDTSKRTISLNLRSVTAADSAVYYCARDQEDSDYIWGSSRVFDI WGQGTMVTVSS | ADI-41371 | Heavy chain variable region ("HC") amino acid sequence |
| Ab 668 | 1336 | ETTLTQPGTLSLSPGERATLSCRASQNVGNNYLAWYQQKPGQAPRVLIQDASTRA TGIPDRFSGSGSGTDFLTISRLEPEDFAVHCQQYGSAPWTFGQGTKVEIK | ADI-41371 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 669 | 1337 | QVQLVQSGAEVKKPGSSVKVSCKASGISSSYAISWVRQAPGQGLEWMGGIIPIFG TTNYAQKFQGRVTITADKSTSTVYMELSSLRSEDSAVYFCARAYCSGGTCYGGADY WGQGTLVTVSS | ADI-41372 | Heavy chain variable region ("HC") amino acid sequence |
| Ab 669 | 1338 | SYELTQPPSVSVSPGQTARITCSGDVLPKQYAYWYQQKLGQAPLLVMYKDTERPSG IPERFSGSSSVTAVTLTISGVQAEDEADYYCQSADSTQELFGGGTKLTVL | ADI-41372 | Light chain variable region ("LC") amino acid sequence |
| Ab 670 | 1339 | QVTLKESGGGLVKPGGSLRLSCAASGFTFSDYFMTWIRQAPGKGLEWVSIISSNSG YTKYAEDVKGRPSISRDNAKTLFLQLNSLSAEDTAVYYCARVEFSGDVPSLFDLW GQGTLVTVSS | ADI-41373 | Heavy chain variable region ("HC") amino acid sequence |
| Ab 670 | 1340 | QSVLTQPPSVSGAPGQRVTISCTGSSNIGAGYHVHWYQQLPGTAPKVLIHGNNN RPSGVPDRFSGSRSGTSASLAITGLQAEDEADYYCQSYDFSLSGWVFGGGTKLTVL | ADI-41373 | Light chain variable region ("LC") amino acid sequence |
| Ab 671 | 1341 | QVQLVQSGAEVKKPGSSVKVSCKAASGTFSNHAIDWVRQAPGQGLEWMGRIIPM VGLATYTRKFQGRVTISVDKSTSTAYMELSSLISDDTAVYYCARRTPEMAWGYWG QGTTVTVSS | ADI-41374 | Heavy chain variable region ("HC") amino acid sequence |
| Ab 671 | 1342 | DIVMTQTPSSLSASVGDRVTITCQASQDIRYYVNWYQQKPGKAPKLLIYDASTLETG VPSRFSGRGSGTDFTLTISSLQPEDIATYYCQQYGDLPTFGQGTRLEIK | ADI-41374 | Light chain variable region ("LC") amino acid sequence |
| Ab 672 | 1343 | QVQLVQSGGGVVQPGRSLRLSCAASGFTISRDNYAIHWVRQAPGKGLEWVAVISYDG SHKYYGDSVKGRFTISRDNSKNTLYLQMNSLRPEDTAVYYCARSRSGSYYSSAIDNW GQGTLVTVSS | ADI-41375 | Heavy chain variable region ("HC") amino acid sequence |
| Ab 672 | 1344 | DIQMTQSPSSLSASVGDRVTIACRASQGISSALAWYRQRPGKAPELLIYDASTLESG VPSRFSGYGAGTDFTLTISSLQPEDFATYYCQQFNSYPSITFGQGTKVEIK | ADI-41375 | Light chain variable region ("LC") amino acid sequence |
| Ab 673 | 1345 | QVQLQESGGGVVQPGRSLRLSCAASGFTFSSYAMHWVRQAPGKGLEWVAVISFD GTANKYYADSVKGRFAISRDNSKNTLYLQMNSLRAEDTAVYYCAKDDAIYSGGWV GDAFDLWGQGTMVTVSS | ADI-41376 | Heavy chain variable region ("HC") amino acid sequence |
| Ab 673 | 1346 | EIVLTQSPATLSVSPGERATLSCRASQVNSNLAWYQQKPGQAPRLLMYGASTRAT GIPARFSGSGSETEFTLTISLQSEDFAVYYCQQYNNWPRTFGQGTKVDIK | ADI-41376 | Light chain variable region ("LC") amino acid sequence |
| Ab 674 | 1347 | QVQLQQSGPGLVKPSQTLSLTCAISGDSVSSDSATWNWIRQSPSRGLEWLGRAYY RSKWYDYAPSVKSRLTINPDTSKNQFSLQLTSVTPQDTAVYFCARDLPPLEYFDGS GYYFLDHWGQGTLVTVSS | ADI-41377 | Heavy chain variable region ("HC") amino acid sequence |
| Ab 674 | 1348 | SYELTQPPSVSVAPGQTARLSCGGHNIGSKSVQWYQQKPDQAPVLVVYDDHDRPS GIPDRFSGSNSGDMATLTISRVEAGDEADYYCQVCESGRDPMVFGGGTKVTVL | ADI-41377 | Light chain variable region ("LC") amino acid sequence |
| Ab 675 | 1349 | EVQLVESGPGLVKPSGTLSLTCAVSGDSISSSNMWSWVRQPPGKGLEWIGEVSHS GNTDYNPSLKSRVTISVDKSKNQFSLKLSSVTAADTAVYYCARPSPCSGGSCYWFFD LWGRGTLVTVSS | ADI-41378 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 675 | 1350 | DIRLTQSPSSLSASVGDRVTITCRASQTINAYLNWYQQRPGKAPNLLIYAASSLQSGV PSRFSGSGSGTDFTLTISSLQPEDFATYYCQQSYKTAYTFGQGTKVEIK | ADI-41378 | Light chain variable region ("LC") amino acid sequence |
| Ab 676 | 1351 | QVQLVQSGAEVKKPGESLKISCKGSYSFSSFWIGWVRQMPGKGLEWMGIIYPGD SDTRYSPSFKGQVTISADTSISTAYLQWSSLKASDTAMYYCAKSIVGSTGSFDPWGQ GTLVTVSS | ADI-41379 | Heavy chain variable region ("HC") amino acid sequence |
| Ab 676 | 1352 | DIQMTQSPSSLSASVGDRVTITCQASQDISNFLNWYQQKPGKAPKLLIYDASNLRT GVPSRFSGSGSGTEFTFTISSLQPEDIATYYCQQYHDLPLLTFGGGTKVDIK | ADI-41379 | Light chain variable region ("LC") amino acid sequence |
| Ab 677 | 1353 | QVQLVQSGAEVKKPGESLKISCKGSGYSFTSYWIGWVRQMPGKGLEWMGIIYPGD SDTRYSPSFQQVTISADKSISTAYLQWSSLKASDTAMYYCASSRAYYDLLTGYYVAS AETQTKAAFDIWGQGTTVTVSS | ADI-41380 | Heavy chain variable region ("HC") amino acid sequence |
| Ab 677 | 1354 | DIQVTQSPSSLSASVGDRVTITCQASQDISNYLNWYQQKPGKAPKLLIYDASNLETG VPSRFSGSGSGTDFSFTISSLQPEDIATYYCQQYDNLITFGQGTKVEIK | ADI-41380 | Light chain variable region ("LC") amino acid sequence |
| Ab 678 | 1355 | QVQLQESGPGLVKPSQTLSLTCTVSGDSISGGEHYWSWIRQPPGKGLEWIGSIYYS GTTYYNPSLKSRLTVSVDTFKNQFSLMLSYVTAADTAVYYCARDASPAYHDYIWGS CRYFDKWGQGTLVTVSS | ADI-41381 | Heavy chain variable region ("HC") amino acid sequence |
| Ab 678 | 1356 | EIVLTQSPGTLSLSPGERATLSCRASQSVSSNYLAWYQQRPGQAPRLLIHGASSRATG IPDRFSGSGSGTDFTLTISRLEPEDFAVYYCQQYGSTPYTFGQGTKVEIK | ADI-41381 | Light chain variable region ("LC") amino acid sequence |
| Ab 679 | 1357 | EVQLVESGGGLVQPGRSLRLSCAASGFTFDDYAMHWVRQAPGKGLEWVSGISWS GDTRGYAESVKGRFTITRDNAKKYLYLQMNSLRAEDTAFYYCAKDAYYFGSGNEKF YYGMDVWGQGTTVTVSS | ADI-41382 | Heavy chain variable region ("HC") amino acid sequence |
| Ab 679 | 1358 | DIVLTQTPATLSVSPGERATLSCRASQNVISNLAWYQQKPGQAPRLLIYGASTRATGI PARFSGSGSGTEFTLTISSLQSEDFAVYYCQQYNNMWPQTFGQGTKVEIK | ADI-41382 | Light chain variable region ("LC") amino acid sequence |
| Ab 680 | 1359 | QVQLVQSGAEVKKPGSSVRVSCKASGGTFSRYAISWVRQAPGQGLEWMGGVIPR FDKTNYAQKFQGRVMITADKSTSTAYMELSSLRSDDTAVYYCAGDRLDTKITHTWY GFGDFWGQGTTVTVSS | ADI-41384 | Heavy chain variable region ("HC") amino acid sequence |
| Ab 680 | 1360 | EIVLTQSPGTLSLSPGERATLSCRASQSVTSNFLAWYQQRPGQAPRLLIYGASVRAID IPDRFSGSGSGTDFTLTISRLEPEDFAVYYCQQYGDPFRTFGQGTKVEIK | ADI-41384 | Light chain variable region ("LC") amino acid sequence |
| Ab 681 | 1361 | EVQLVESGGGVVQPGRSLRLSCAASGFTFSSYGMHWVRQAPGKGLEWVAVIWYD GNNEKYADSVKGRFTISRDNSKNTLYLQMNSLRAEDTAVYYCARPTQKYSSSWYW EDSIDYWGQGTLVTVSS | ADI-41385 | Heavy chain variable region ("HC") amino acid sequence |
| Ab 681 | 1362 | QSVLTQPPSVFGAPGQRVTISCTGSSSNIGAGYPVHWYQQLPGTAPKLLIYGNSNR PSGVPDRFSGSKSGTSASLAITGLQAEDEADYYCQSYDSSLSGGVVFGGGTKLTVL | ADI-41385 | Light chain variable region ("LC") amino acid sequence |
| Ab 682 | 1363 | QVQLVQSGAEVKKPGASVKVSCKASGYTFTGNYIHWVRQAPGQGLEWMGGINP NSGATNYARKFQGRISMTRDTSINTAYMEVSSLRSDDTATYYCARDAPPVVIPAAIH WFDAWGQGTLVTVSS | ADI-41386 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 682 | 1364 | SYELTQPPSASGTPGQRVTISCSGSSSNIGENTVNWYQQFSGTAPRLLIYRTNQRPS GVPDRFSGSKSGTSASLVISGLQSEDEADYYCASWHDTLNDVVFGGGTKLTVL | ADI-41386 | Light chain variable region ("LC") amino acid sequence |
| Ab 683 | 1365 | EVQLVESGGGVVQPGRSLRLSCAASGFTSNYAIHWVRQAPGKGLEWVAAISYDG GNKFYADSVKGRFTISRDNSRNTLYLQMNSLRPEDTAVYYCARDRWELNYGIDVW GQGTTVTVSS | ADI-41389 | Heavy chain variable region ("HC") amino acid sequence |
| Ab 683 | 1366 | SYELMQPPSVSVSPGQTARITCSGDALPKQYAYWYQQKPGGQAPVLVIYKDSERPSG IPERFSGSTSGTTVTLTISGVQAEDEADYYCQSADSSSTFPYVFGTGTKLTVL | ADI-41389 | Light chain variable region ("LC") amino acid sequence |
| Ab 684 | 1367 | EVQLVESGGGLVKPGGSLRLSCAASGFSSSSYFMNWVRQAPGKGPEWVSSISGSSS FINYADSVKGRFTISRDNAKNSLYLQMNSLRAEDTAVYYCARAVLPAGVGGYWFDS WGQGTLVTVSS | ADI-41390 | Heavy chain variable region ("HC") amino acid sequence |
| Ab 684 | 1368 | QSVVTQPPSVSGAPGQRVTISCTGSSSNIGAGYDVHWYQHLPGRAPKLLIYGNSNR PSGVPDRFSGSKSGTSASLVITGLQAEDEADYCCQSYDSSLLSGAVPFGGGTQLTVL | ADI-41390 | Light chain variable region ("LC") amino acid sequence |
| Ab 685 | 1369 | EVQLLESGPGLVKPSETLSLTCTVSGGSISGYYWSWIRQPPGKGLEWIGYIYHSGGST NYNPSLKSRVTISVDTSKNQFSLKVSSVTAADTAVYYCARLLARVVTTFDFWGQGAL VTVSS | ADI-41391 | Heavy chain variable region ("HC") amino acid sequence |
| Ab 685 | 1370 | QPVLTQPASVSGSPGQSITISCTGTSSDVGGYNYVSWYQQKPGTAPKLMIFDVSNR PSGVSNRFSGSKSDNTASLTISGLQAEDEADYYCSSYTSSTNLVFGGGTKLTVL | ADI-41391 | Light chain variable region ("LC") amino acid sequence |
| Ab 686 | 1371 | EVQLVESGGGVVQPGGSLRLSCAASGFEFRDYAMHWVRQAPGKGLEWVALISYD GSKIHYADSVQGRFTISRDNSKNSLYLQMNSLRSEDSAKYYCVQDHWLVPAFWGQ GAQVTVSS | ADI-41392 | Heavy chain variable region ("HC") amino acid sequence |
| Ab 686 | 1372 | QPVLTQPASVSGSPGQWITISCTGTSTSDIGYYDYVSWYQQYPGKAPKLIIYEVSHRPS GVSNRFSGSKNTASLSISGLQAEDEADYYCCSYTTSNAGVFGTGTKLTVL | ADI-41392 | Light chain variable region ("LC") amino acid sequence |
| Ab 687 | 1373 | QVQLVQSGAEVKKPGESLKISCKGSGYSFTSYWIGWVRQMPGKGLEWMGIIYPGD SDTRYSPSFQGQVTISADKSTSTAYLQWSSLKASDSAMYYCARSEPSSSFDFWGQG TLVTVSS | ADI-41393 | Heavy chain variable region ("HC") amino acid sequence |
| Ab 687 | 1374 | NFMLTQPHSVSESPGKTVTISCTGSSGSIASYYVQWYQLRPGSAPTTVIYEDNQRLS GVPDRFSGSIDSSSNSASLTIISGLKTEDEADYYCQSYRSGIPWVFGGGTKLTVL | ADI-41393 | Light chain variable region ("LC") amino acid sequence |
| Ab 688 | 1375 | QVQLVQSGAEVKKPGSSVKVSCKASGGTFNTYAISWVRQAPGQGLEWMGGIIPIL GVSNYAQRFQGRVTFSADELNTAYMELSSLRSEDTAVYFCARPVGAYTLGDAFEI WGRGTVTVSS | ADI-41394 | Heavy chain variable region ("HC") amino acid sequence |
| Ab 688 | 1376 | QPVLTQSSSASASLGSSVKLTCTLSSGHSDFIIAWHQQQPGKAPRYLMKFEGNGRY SKGSGIPDRFSGSSSGADRCLTISNLQSEDEADYYCETWDSNTHVFGGGTKLTVL | ADI-41394 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 689 | 1377 | EVQLVESGGGLVNPGGSLRLSCVVSGPAFSSYGMMVRQAPGKGLEWVSSISASS SYIDYADSVKGRFIISRDNAKNSLHLQMNSLRAEDTAVYYCARLGYDSSTYTNWFD PWGRGTLVTVSS | ADI-41396 | Heavy chain variable region ("HC") amino acid sequence |
| Ab 689 | 1378 | QSVVTQEPSVSGAPGQRVTISCTGSSSNIGTGYDVHWYQQLPGAAPKLLIYGNSNR PSGVPDRISGSKSGTSASLAITGLQAEDEADYYCQSYDSSLSGYVFGTKVTVL | ADI-41396 | Light chain variable region ("LC") amino acid sequence |
| Ab 690 | 1379 | EVQLVESGGGLVKPGGSLRLSCAASGFKFSSYYLNWVRQAPGKGLEWVSSISGGSS YINYADSVKGRFTISRDNAKNTLDLQMSNLRAEDTAVYYCARVVGATGPLYFDLWG RGTLVTVSS | ADI-41397 | Heavy chain variable region ("HC") amino acid sequence |
| Ab 690 | 1380 | QSVLTQPPSVSGAPGQRVTISCTGSSSNIGAGYDVHWYQQFPGTAPKLLIYGNNNR PSGVPDRFSGSKSGTSASLAITGLQAEDEADYYCQSYDSSLSGYVPGAGTKVTVL | ADI-41397 | Light chain variable region ("LC") amino acid sequence |
| Ab 691 | 1381 | EVQLLESGAEVKKPGASVKVSCKASGYTFTNYGISWVRQAPGQGLEWMGWISAY NGNTNYAQKLQGRVTMTDTSTSTAYMELRSLRSDDTAVYYCARDGGVIAAATLG YWGQGTLVTVSS | ADI-41398 | Heavy chain variable region ("HC") amino acid sequence |
| Ab 691 | 1382 | EIVLTQSPLSLPVTLGQPASISCRSSQSLVVYSDGNTYLSWFQQRPGQSPRRLIYKLSNR DSGVPNRFSGSGSGTDFTLKISRVEAEDVGIYYCMQGIYWPPTFGQGTKVEIK | ADI-41398 | Light chain variable region ("LC") amino acid sequence |
| Ab 692 | 1383 | QVQLVQSGAEVKKPGASVKVSCKASGYTFTFAIHWVRQAPGQRLEWMGWINA GNGNTKYSQKFQGRVTITRDTSASTAYMELSSLRSEDTAVYYCARPEISSSSLNEKDD YWGQGTLVTVSS | ADI-41399 | Heavy chain variable region ("HC") amino acid sequence |
| Ab 692 | 1384 | QPVLIQPASVSGSPGQSITISCTGTSSDVGAYDFVSWYQQHPGKAPKFMIYEVSHR PSGVSNRFSGSKSGNTASLTISGLQAEDEADYYCSSYTTSNTLVFGGGTKLTVL | ADI-41399 | Light chain variable region ("LC") amino acid sequence |
| Ab 693 | 1385 | EVQLLESGGGLIQPGGSLRLSCAASKFTFSDYEMNWVRQAPGKGLEWLSYISSSGGI MYYADSVKGRFTISRDNAKNSLYLQMNSLRAEDTAVYFCARAGRLLSGLDVWGHG TTVTVSS | ADI-41400 | Heavy chain variable region ("HC") amino acid sequence |
| Ab 693 | 1386 | EIVLTQSPSTLSASVGDRVTITCRASQSISPWLAWYQQKPGKAPKLLIYRASSLETGV PPRFSGSGSGTEFTLTISSLQPDDFATYYCQHYNSYLYSFGQGTKVEIK | ADI-41400 | Light chain variable region ("LC") amino acid sequence |
| Ab 694 | 1387 | EVQLLESGGGLVHPGRSLRLSCAASGFTFGDYAMHWVRQAPGKGLEWVSGISWN SDTIEYADSVKGRFTISRDNAKNSLYLQMNSLRAEDTALYYCAKDFGSSWEAYFDY WGQGTLVTVSS | ADI-41401 | Heavy chain variable region ("HC") amino acid sequence |
| Ab 694 | 1388 | DIVLTQSPSYLSASVGDRVTITCRASQSISTYLNWYQQKPGKAPKLLISAASSLQSGVT SRFSGSGSGTDFSLTISSLQPEDFATYYCQQSYSTALTFGGGTKVEIK | ADI-41401 | Light chain variable region ("LC") amino acid sequence |
| Ab 695 | 1389 | EVQLVESGGGLVKPGGSLRLSCAASGFTFSSYTMNWVRQAPGKGLEWVSSISSSSS HIYYADSVKGRFTISRDNARKALYLQMNSLRPEDTAVYFCARFLGDYGGDNTYYY YYGMDVWGQGTTVTVSS | ADI-41403 | Heavy chain variable region ("HC") amino acid sequence |
| Ab 695 | 1390 | EIVMTQSPLSLPVTGEPASISCRSSQSLLHSNGKNYLDWYLQKPGQSPQLLIHLGS NRASGVPDRFSGSGSGTDFTLQISRVEAEDVGYYCMQALQTPFTGGGTKLEIK | ADI-41403 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 696 | 1391 | QVQLVQSGAEVKKPGSSVKVSCKASGTFSSYGISWVRQAPGQGLEMMGGIIPIF GTVSYAQKFRGRLTITAHEPTSTAYMDLSSLRSEDTAVYYCARINGRGWELSSLNVY YGMDVWGQGTTVTVSS | ADI-41404 | Heavy chain variable region ("HC") amino acid sequence |
| Ab 696 | 1392 | EIVLTQSPGTLSLSPGERGTLSCRASQSVASSYLAWYQQKPGQAPRLLIYGATSRATG IPDRFSGSGSGTDFTLTISRLEPEDFAVYYCQQYGSSLFTFGGGTKVDIK | ADI-41404 | Light chain variable region ("LC") amino acid sequence |
| Ab 697 | 1393 | EVQLLESGGGLVQPGGSLRLSCAASGFSFSIYSMNWVRQAPGKGLEWISITTSTGSP TYYADSVKGRFTISRDNAKNSLYLQMSLRAEDTAVYYCVTYCSSSSCPAEFDYWGQ GTLVTVSS | ADI-41405 | Heavy chain variable region ("HC") amino acid sequence |
| Ab 697 | 1394 | EIVLTQSPATLSLSPGERATLSCRASQVNSYLAWYQQKPGQAPRLLIYDASNRATGI PARFSGSGSGTDFTLTISSLEAEDFAVYYCQHRNNMPALTFGGGTKVEIK | ADI-41405 | Light chain variable region ("LC") amino acid sequence |
| Ab 698 | 1395 | EVQLVESGGNLVQPGGSLRLSCAASGFTFSSYVMNWVRQAPGKGLEMVSGISGS GGTSYADSVKGRFTISRDNSNNTLYLQMKSLRAEDTAVYYCAKDPRFQKWLIEGT NWFDSWGQGTLVTVSS | ADI-41406 | Heavy chain variable region ("HC") amino acid sequence |
| Ab 698 | 1396 | DIQVTQSPSSLSASVGDRVTITCRASQDVSNYLAWFQQKPGTAPKSLIYAASILQSG VPSKFRGSGSGTDFSLTISSLQPEDFATYYCQQYRSFPPTFGGGTKVEIK | ADI-41406 | Light chain variable region ("LC") amino acid sequence |
| Ab 699 | 1397 | EVQLVESGGGLVQPGGSLRLSCAASGFTFSSNAMSWVRQAPGKGLEMVSYISGGS ATKSYADSVKGRFTISRDNSKNTLYLQMKSLRAEDTAVYYCVGGSAYYSGFDYWGQ GTLVTVSS | ADI-41407 | Heavy chain variable region ("HC") amino acid sequence |
| Ab 699 | 1398 | DIVMTQSPSSLSASVGDRVTISCRASQDIRNYLAWYQQKPGKVPNLLIYAASTLESG VPSRFSGSGYGTDFTLTISGLQPEDVATYYCQKYDSAPPFTFGPGTKVDIK | ADI-41407 | Light chain variable region ("LC") amino acid sequence |
| Ab 700 | 1399 | QVQLVESGAEVKKPGESLKISCRDSGYSFSSFWIGWVRQMPGKGLEMVGIIYPGDS DIRYSPFQGRVTISADKSISTAYLQWRSLKASDSAMYYCARSEKLGSFDRWGQGTL VTVSS | ADI-41408 | Heavy chain variable region ("HC") amino acid sequence |
| Ab 700 | 1400 | DIQMTQSPSSLSASVGDRVTITCQANRDISNCLNWYQQRPGKAPELLIYDASYLETG VPSRFTGSGSGTDFTFTISSLQPEDIATYYCQQYDNLLFTFGPGTKVEIK | ADI-41408 | Light chain variable region ("LC") amino acid sequence |
| Ab 701 | 1401 | QVQLVQSGAEVKKPGASVKVSCKASGYTFTNYGISWVRQAPGQGLEMMGWISA YNGNTNYAQKFQDRVTMTTDISTSTAYMELRSLRYDDTAVYYCARDTPGEYASA MFDHWGQGTLVTVSS | ADI-41409 | Heavy chain variable region ("HC") amino acid sequence |
| Ab 701 | 1402 | DIVMTQSPLSLPVTLGQPASISCRSSQSLVYSDGNTYLSWFQQRPGQSPRRLIYKVS NRDSGVPDRFSGSGSGTDFTLKISGVEAEDVGVYYCMQGTHWPPTFGQGTKLEIK | ADI-41409 | Light chain variable region ("LC") amino acid sequence |
| Ab 702 | 1403 | EVQLLESGGLAQPGRSLKVSCAASGVTVTSTYMGWVRQAPGKGLQMVSVIYSD GTTYADSVKGRFTISRDHYKNTLYLQMNSLRAEDTALYYCARGNRRTDFGYWGQ GTLVTVSS | ADI-41414 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 702 | 1404 | EIVMTQSPSTLSASVGDRVTITCRASQTISNWLAWYQQKPGKAPKLLIYQASTLESG VPSRFSGSGSGTEFTLTISSLQPDDFATYYCQQYNTYTFGPGTKVEIK | ADI-41414 | Light chain variable region ("LC") amino acid sequence |
| Ab 703 | 1405 | QVTLKESGPALVKPTQTLTLTCTFSGFSLSTSRTRVSWIRQPPGKALEWLARVDWD DDKFYNPVLKIRLSISKDPSKNQVVLTMTNVDPVDTATYYCVRMAHYGSGYYVE YFQDWGQGTLVTVSS | ADI-41415 | Heavy chain variable region ("HC") amino acid sequence |
| Ab 703 | 1406 | DIQLTQSPASLSASAGDRVTITCRASQNINRYLNWYQQQSGKAPKLLIYAASILQSG VPSRFSGSGSGTDFTLTITSLQPEDFAIYYCQQSYTTPKYTFGQGTKVEIK | ADI-41415 | Light chain variable region ("LC") amino acid sequence |
| Ab 704 | 1407 | EVQLVESGGGLVKPGGSLRLSCAASGFKFSSYTMNWVRQAPGCKGLEWVSSITGGS SFINYADSVKGRFTISRDNAKNSLYLQMVSLRAEDTAVYYCARDLSSHITIFGAVSDY WGRGTTVTVSS | ADI-41416 | Heavy chain variable region ("HC") amino acid sequence |
| Ab 704 | 1408 | QSVLTQPPSVSGAPGQRVTISCTGSSNIGAGYDAHWFQQLPGSAPKLLIYANTNR PSGVPDRFSGSKSGTSASLAITGLQAEDEADYYCQSYDSTLSVPFGGGTKLTVL | ADI-41416 | Light chain variable region ("LC") amino acid sequence |
| Ab 705 | 1409 | QVQLVESGGGLVKPGGSLRLSCAASGFTFSSYSMNWVRQAPGKGLEWVSSISAGS SYIYYADSLKGRFTISRDNAKNSLYLQMNSLRAEDTAVYYCARVNTHYYDSSAYHNF DSWGQGTLVTVSS | ADI-41417 | Heavy chain variable region ("HC") amino acid sequence |
| Ab 705 | 1410 | QPVLTQPPSVSGAPGQRVTISCTGSSNIGAGYDVHWYQQLPGTAPKLLIYGNTNR PSGVPERFSGSKSGTSASLAITGLQAEDEADYYCQSYDTNLSAPWVFGGGTKLTVL | ADI-41417 | Light chain variable region ("LC") amino acid sequence |
| Ab 706 | 1411 | EVQLVESGGGLVKPGGSLRLSCAASGLSFTDAWMGWVRQAPGKGLEWVGHIKKK TDYGPTAYAAPVRGRFTVSRDDSKNTLYLQMTSLKTEDTAVYYCIITERGYNFGYND YFGVDVWGQGTLVTVSS | ADI-41418 | Heavy chain variable region ("HC") amino acid sequence |
| Ab 706 | 1412 | QPGLTQPPSVSVSPGQTARITCSGDALPKKYAYWYQQKSGQAPVMIIYEDNKRPSG IPERFSGSTSGTMATLTISGAQMEDEADYYCFSTDSGDDQSGVFGGGTRLTVL | ADI-41418 | Light chain variable region ("LC") amino acid sequence |
| Ab 707 | 1413 | EVQLVESGGGLVQPGRSLRLSCAASGFTFDDYAMHWVRQAPGKGLEWVSGISW NSGSVGYSDSVKGRFTISRDNAKSSLYLQMNNLRAEDTALYYCARDMAHTQDYFD TSEYDSWGQGTLVTVSS | ADI-41419 | Heavy chain variable region ("HC") amino acid sequence |
| Ab 707 | 1414 | QPVLTQPASVSGSPGQSITISCTGTSSDIGAYNYVSWYQQHPGKAPKLVVTEVNNR PSGISNRFSGSKSGNTASLTISGLQAEDEADYYCSSYTVSATLVFGGGTKLTVL | ADI-41419 | Light chain variable region ("LC") amino acid sequence |
| Ab 708 | 1415 | EVQLLESGGGVVQPGRSLRLSCAASGFTFSSYAMHWVRQAPGKGLEWVAVISYDG SNKYYADSVKGRFTISRDNSKNTLYLQMNSLRAEDTAVYYCARVPCSSTSCYTTDY WGQGTLVTVSS | ADI-41420 | Heavy chain variable region ("HC") amino acid sequence |
| Ab 708 | 1416 | QPVLTQPPSVSGSPGQSVTISCTGTSSDVGSYNRVSWYQQPPGTAPKLMIYEVSNR PSGVPDRFSGSKSGNTASLTISGLQAEDEADYYCSSYTSSSPVFGGGTKVTVL | ADI-41420 | Light chain variable region ("LC") amino acid sequence |
| Ab 709 | 1417 | QVQLVESAAEVKRPGASLKVSCKASGYTFIDYDISWVRQAPGQGLDMGWISTY DGSAKYPENLQARVAMTTDTSTSTAYMELESLTSDDTAVYYCARARRGSSGWVST TGPTPFDYWGRGTLVTVSS | ADI-41421 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 709 | 1418 | SYELTQPPSVSVSPGQTARITCSGDALPKRYAYWYQQKSGQAPVLVIYEDNKRPSGI PERFSGSSSGTVATLTISGAQVEDEADYCYSTDATGNHRGLFGGGTKLTVL | ADI-41421 | Light chain variable region ("LC") amino acid sequence |
| Ab 710 | 1419 | QVQLVESGGGLVKPGGSLRLSCAASGFTFSSYSMNWVRQAPGKGLEWVSSISSSSS YIYYADSVKGRFTISRDNAKNSLYLQMNSLRAEDTAVYYCARDPSSSWNRNDYWG QGTLVTVSS | ADI-41423 | Heavy chain variable region ("HC") amino acid sequence |
| Ab 710 | 1420 | QSVLIQPASVSGSPGQSITISCTGTSSDVGGYNYVSWYQQHPGKAPKLMIYDVSNR PSGVSNRFSGSKSGNTASLTISGLQAEDEADYCCSSYTSSSTLVVFGGGTKVTVL | ADI-41423 | Light chain variable region ("LC") amino acid sequence |
| Ab 711 | 1421 | QVQLVQSGAEVREPGASVKVSCCKPSGYTFANYGISWVRQAPGQGLEWMAWISAY NGNTNYAPKVQGRVSVTTDSSTGIGYMELRSLRSDDTAVYYCVRDTPAIAGAAATLD FWGQGTLVTVSS | ADI-41424 | Heavy chain variable region ("HC") amino acid sequence |
| Ab 711 | 1422 | DIVLTQSPLSLAVTPGQSASISCRSRQSHVFSDGNTYVSWFQQRPGRSPRRLIYRVSY RDSGVPDRFSGSGSGSDFTLRISRVEAEDVGVYYCMQGTHWPRTFGQGTKLEIK | ADI-41424 | Light chain variable region ("LC") amino acid sequence |
| Ab 712 | 1423 | EVQLLESGPAVVKPTQTLTLTCTVSGLSLSSPRMSVSWIRQPPGKGLEWLARIDWD GDKYYGTSLKTRLSISKDTSKNQVVLTMTNMDPVDTGTYYCAQTSIYASNAYYLARL DPWGQGMLVTVSS | ADI-41425 | Heavy chain variable region ("HC") amino acid sequence |
| Ab 712 | 1424 | EIVMTQSPSLLSASVGDRVTITCRASQNIATYLNWYQQKPGKAPRLLIYAASNLQSG VPSGFSGSGSGTVFTLTISSLQPEDFATYFCQQSYETSLIFGGGTKVEIK | ADI-41425 | Light chain variable region ("LC") amino acid sequence |
| Ab 713 | 1425 | QVQLVESGPGLVKPSETLSLTCTVSGGSIGGYYWSWIRQPPGKGLEWIGYMYYSGS TNYNPSLKSRVIMSVDTSKNQFSLKLTSVTAADTAVYYCARVLRFLVGGMDVWGQ GTTVTVSS | ADI-41427 | Heavy chain variable region ("HC") amino acid sequence |
| Ab 713 | 1426 | QSVLIQPASVSGSPGQSITISCTGTSSDVGGVNYVSWYQQHPGKAPKLIIYEVSNRPS GVSNRFSGSKSGNTASLTISGLQAEDEADYYCNSYTTIATLVFGTGTKVTVL | ADI-41427 | Light chain variable region ("LC") amino acid sequence |
| Ab 714 | 1427 | QVQLVQSGAEVKKPGSSVKVSCKASGGTFSSYAISWVRQAPGQGLEWMGGIIPIF GTVNYAQKFPGRVTITADESTSTAYMELSSLRSEDTAIYYCARDSPSYTGSLLFSQYYY GMDVWGQGTTVTVSS | ADI-41429 | Heavy chain variable region ("HC") amino acid sequence |
| Ab 714 | 1428 | QPVLTQPASVSGSPGQSITISCTGTSSDVGGYDYVSWYQHPGKAPKLMIYEVSNR PSGVSNRFSGSKSGNTASLTISGLQAEDEADYCCSSFTTSSPRVFGTGTKLTVL | ADI-41429 | Light chain variable region ("LC") amino acid sequence |
| Ab 715 | 1429 | QVQLVQSGAEVKKPGASVKVSCTASGVRFFTYGITWVRQAPGQGLEWMGISAY NGNTKFAQKFQGRLTMTTDAPTSTADMELRGLRSDDTAVYYCAREEGGYHGTGS NNYWGQGTLVTVSS | ADI-41431 | Heavy chain variable region ("HC") amino acid sequence |
| Ab 715 | 1430 | QSVLTQPPSVSAAPGQKVTISCSGSGSNVGGNDVSWVQQFPGTAPKLLIYDNSKRP SGIPDRFSGSKSGTSATLVITGLQTGDEADYYCGTWDSSLSVGVFGTGTKLTVL | | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 716 | 1431 | QVQLVQSGAEVKKPGYSVKVSCKASGGTFSTFGISWVRQAPGLGLEWMGGIIPLFGTADYSKKYQGRVTITADESTSTGYMELNSLTPEDTAVYYCARSPGHLWSRYDAFEVWGQGTTVTVSS | ADI-41432 | Heavy chain variable region ("HC") amino acid sequence |
| Ab 716 | 1432 | QPVLTQPRSVSGSPGQSVTISCSGTSSDVGGYNYVSWYQQYPGKAPKLIIYDVNKRPSGVPDRFSGSKSDNTASLTISGLQADDESDYFCCSYAGSHTFEVFGTKVTVL | ADI-41432 | Light chain variable region ("LC") amino acid sequence |
| Ab 717 | 1433 | EVQLLESGGGAVQPGRFLRLSCAASGFTFRSYGMHWVRQAPGKGLEWVAVISYDGSDKYYADSVKGRFTIISRDNSKNTLFLLMNGLRAEDAAVYYCAKDIASAGTLRGSDVWGQGTMVTVSS | ADI-41433 | Heavy chain variable region ("HC") amino acid sequence |
| Ab 717 | 1434 | QPVLTQPRSVSGSPGQSVTISCTGTSSDVGGFNYVSWYQQHPGKAPKLMIYDVRVRPSGVPDRFSGSKSGNTASLIISGLQGEDEADYYCCSYTVTYTLVPGGGTKLTVL | ADI-41433 | Light chain variable region ("LC") amino acid sequence |
| Ab 718 | 1435 | EVQLVESGGGLVQPGRSLRLSCEAASGFTFDDYAMHWVRQTPGKGLEWVSGISWNSGSIVYADSVKGRFTIISRDNAKNSLYLQMHSLRPEDTALYYCAKDNYTFGNYYYYGMDVWGQGTTVTVSS | ADI-41434 | Heavy chain variable region ("HC") amino acid sequence |
| Ab 718 | 1436 | EIVLTQSPVTLSVSPGERATLSCRASQNVISNLAWYQQKPGQAPRLLIYGASTRATGIPARFSGSGSGTEFTLTISSLQSEDFAVYYCQQYNNMWPLSFGGGTKVEIK | ADI-41434 | Light chain variable region ("LC") amino acid sequence |
| Ab 719 | 1437 | EVQLLESGGGLVKPGGSLRLSCAASGFTFSSYSLNWVRQAPGKGLEWVSSISSSGTYIFYADSVKGRFTISRDNAKDSLFLQMNSLRAEDTAVYYCARARDMGNYDILTGYYRVDAFDIWGQGTMVTVSS | ADI-41435 | Heavy chain variable region ("HC") amino acid sequence |
| Ab 719 | 1438 | QSVLTQPPSASKTPGQRVTISCSGSGSNIGGNTVNMVYQQLPGTAPKLLIYTNDQRPSGVPDRFSGSKSGTSASLAISGLQSEDEADYYCAAWDDSLNGWVFGGGTKLTVL | ADI-41435 | Light chain variable region ("LC") amino acid sequence |
| Ab 720 | 1439 | EVQLLESGGGVVQPGRSLRLSCAASGFTFSDYAMHWVRQAPGKGLEWVALISFDGSNEYYADSVKGRFTISRDNSRNTVYLQVNTLRPDDTAVFYCARDSHLRLTTRGWGSFDYWGQGTLVTVSS | ADI-41436 | Heavy chain variable region ("HC") amino acid sequence |
| Ab 720 | 1440 | NFMLTQPHSVSESPGKTVTIACTRSSGSIARNYVQWYQQRPGRSPTMVIYEDNQRPSGVPDRFSGSIDTSSNSASLTISGLKTEDEADYYCQPYDPDNLVFGGGTKLTVL | ADI-41436 | Light chain variable region ("LC") amino acid sequence |
| Ab 721 | 1441 | QVQLVQSGGEVKKPGASVKVSCKASGYTFTHYGISWARQAPGQGIEWMGWINVHNGNTEYAQRFQGRVTMTTDTSTNTAYMEMTSLTSDDTAVYYCARDKIVVVVPNYHGMDVWGQGTLVTVSS | ADI-41437 | Heavy chain variable region ("HC") amino acid sequence |
| Ab 721 | 1442 | EIVLTQSPDSLAVSLGERATINCKSSQSVLYRANNRNYLAWYQQKPGQPPKLLIYWASTRESGVPDRFSGSGSGTDFTLTISSLQAEDVALYYCHQHSSPRTFGQGTKVDIK | ADI-41437 | Light chain variable region ("LC") amino acid sequence |
| Ab 722 | 1443 | QVQLVQSGAEMRRPGSSVRLPCKASGYTFVSHTIVNVRQPGQGLEWMGGIIPSLRTPNYAQNFQDRLTITADESARTAYMELSSLTSNDTAVYYCARETFQGGYLDYWGQGTLVTVSS | ADI-41438 | Heavy chain variable region ("HC") amino acid sequence |
| Ab 722 | 1444 | EIVMTQSPGTLSVSPGDTAALSCRASQSVGRNLAWYQQKPGQAPRLLIFGASTRAADIPGRFSGSGSGTEFTLTITSLQSEDFAVYYCQQYNKWPPYTFGQGTKVEIK | ADI-41438 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 723 | 1445 | QVQLVQSGTEVKNPGASVKVSCKASGYTFSNYGITNVRQAPGQGLEMMAWISAY NGNILYAQNVQRVIMTTDTSTSTGVMELRSLRSDDTAVYYCARDAPAGTLILLDY WGQGTLVTVSS | ADI-41439 | Heavy chain variable region ("HC") amino acid sequence |
| Ab 723 | 1446 | DIVMTQTPLSLPVTLGQPASISCRPSQSLVYSDGNTYLNWFQQRPGQSPRRLIYKVS NRDSGVPDRFSGSGSGTDFTLRISRVEAEDVGVYYCMQGSHWPYAFGQGTKVEIK | ADI-41439 | Light chain variable region ("LC") amino acid sequence |
| Ab 724 | 1447 | EVQLVESGGGLVKPGGSLRLSCAVSGFTFSDYTMNWVRQAPGKGLEWVSSISGSG TYIYYGDSVKGQFTISRDNAKNSLYLQMNSLRAEDTAVYYCARELPAKTIFGVDFLG GTTAYDCWGQGTPVTVSS | ADI-41440 | Heavy chain variable region ("HC") amino acid sequence |
| Ab 724 | 1448 | EIVLTQSPATLSVSPGERATLSCRASQSVSSNLAWYQQKPGQAPRLLIYSATTRAIG VPARFSGSGSGTEFTLTISSLRSEDFAVYYCQQYNNGGTFGPGTKVEIK | ADI-41440 | Light chain variable region ("LC") amino acid sequence |
| Ab 725 | 1449 | EVQLVQSGPGLVKPSETLSLICSVSGASISRYHYMGWIRQSPGKGLEWIGTIYYSG TTYYNPSLESRVTISADTSKNQVSLKLTSVTAADTAVYYCARGSGDTALDFSFEYWG QGALVTVSS | ADI-41441 | Heavy chain variable region ("HC") amino acid sequence |
| Ab 725 | 1450 | DIQLTQSPSFLSASVGDRITITCRASQGISNSLAWYQQKPGKAPKLLIYAASTLQFAV PSRFSGSGSGTEFTLTISSLQPEDFATYYCQQLDSYPLTFGGGTKLEIK | ADI-41441 | Light chain variable region ("LC") amino acid sequence |
| Ab 726 | 1451 | EVQLLESGGGLVQPGRSLRLSCAASGFTFDDYAMHWVRQAPGKGLEWVSGISWH SGSIVYADSVKGRFTISRDNAKNSLYLQMSSLRAEDTALYYCVKDHYNWNDNPHFH YGLDVWGQGTTVTVSS | ADI-41442 | Heavy chain variable region ("HC") amino acid sequence |
| Ab 726 | 1452 | EIVLTQSPATLSVSPGERATLSCRASQSVISNLAWYQQKPGQAPRLFIYGASTRATGI PARFSGSGSGTEFTLTISSLQSEDFAVYFCQQYNNMPITFGQGTRLEIK | ADI-41442 | Light chain variable region ("LC") amino acid sequence |
| Ab 727 | 1453 | EVQLVESGGGVVQPGKSLRLSCAASGFTFSSYAMHWVRQAPGKGLEMVSVIWYE DSDKYYGDSVKGRFTISRDNSKNTLYLQMNSLRAEDTAVYYCARKSGGFGGLDYW GQGTLVTVSS | ADI-41443 | Heavy chain variable region ("HC") amino acid sequence |
| Ab 727 | 1454 | DIVMTQSPLSLPVTPGEPASISCKSSQSLLTANGYNYLDWYVQKPGQSPHVLISLGS NRASGVPDRFSGSGSGTDFTLKISRVEAEDVGVYYCMQAIETPITFGQGTRLEIK | ADI-41443 | Light chain variable region ("LC") amino acid sequence |
| Ab 728 | 1455 | EVQLVESGPRLVKPSQTLSLTCTVSGGSIGTGDYHMTWIRQSPGKGLEWIGNIYYN GRTFYNPSLKGRGSISRDASKNQFSLNLSSVSAADTAVYYCARDRAAKGFDHWGQ GTLVTVSS | ADI-41444 | Heavy chain variable region ("HC") amino acid sequence |
| Ab 728 | 1456 | DIQLTQSPSTLSASVGDRVTITCRASQNINGWLAWYQQKPGRVPKLLIYASTLESG VPSRFSGSASGTEFTLTINNLLPDDFATYYCQQYNDYPYTFGQGTKVEIK | ADI-41444 | Light chain variable region ("LC") amino acid sequence |
| Ab 729 | 1457 | QVQLVQSGAEVKRPGSSVKVSCKAFGSFSNVAINWVRQAPGQGLEMMGGISPV LGTAIYAKRFQGKVTITADKFANTAVMDLSSLRFEDTAVYYCARSPPHVEFPLTKWF DPWGQGTLVTVSS | ADI-41445 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 729 | 1458 | EIVMTQSPGTLSLSPGERATLSCRASQSVNSGYLAWYQHKPGRAPRLLIYGASNRAT GVPDRFSGSGSGTDFTLTISRLEPEDFAVYYCQQYDNSLFTFGPGTVDIK | ADI-41445 | Light chain variable region ("LC") amino acid sequence |
| Ab 730 | 1459 | EVQLLESGGGLVQPGGSLRLSCAASGFTYYSYAMNWVRQAPGKGLEWVSAISGG GDNTFYAESVKGRFTISRDNAKNTLYLQMDSLRAEDTAVYYCAKDLQGYTSLYCFDY WGQGTLVTVSS | ADI-41446 | Heavy chain variable region ("HC") amino acid sequence |
| Ab 730 | 1460 | EIVMTQSPATLSLSPGERAALSCRASQSVFNYVAWYQQKPGQAPRLLIYDTSKRAT GIPARFSGSGSGTDFTLTISSLEPEDFAVYYCQHRYNWPGLIFGGGTKVEIK | ADI-41446 | Light chain variable region ("LC") amino acid sequence |
| Ab 731 | 1461 | EVQLLESGGGLVQPGGSLRLSCAASGFTFSTYAMNWVRQAPGCKGLEWVSTISGSG GSTYYGDSVKGRFTISRDNSKNTLYLQMNSLRAEDTAVYYCAKAPTPWCSGGSCYV SYWGQGTLVTVSS | ADI-41447 | Heavy chain variable region ("HC") amino acid sequence |
| Ab 731 | 1462 | DIVMTQTPGTLSLSPGERGTLSCRASQSVSSSYLAWYQQKPGQAPRLLIYGASSRAT GIPDRFPGGSGSGTDFTLTISTLEPEDFAVYYCQQYQSSPWTFGQGTKLEIK | ADI-41447 | Light chain variable region ("LC") amino acid sequence |
| Ab 732 | 1463 | TVQLVESGAEVKSPGSVRVSCQASGSSVRSCQASGSNSYAISNVRQAPGQGLEWMGMISPLF GTTRFSQRFQGRVTITADKSTSTAYMELSSLNSEDTALYYCARGRFDFWSGPTRFYY TMDVWGQGTMVTVSS | ADI-41448 | Heavy chain variable region ("HC") amino acid sequence |
| Ab 732 | 1464 | QSVLIQPASVSGSPGQSITISCSGTSSDIGYYNYVSWYQQHPGKAPKLLISDVTDRPS GISDRFSGSKSGTSASLTISGLQADDEADYYCTSYTTSSTMVFGGGTKLTVL | ADI-41448 | Light chain variable region ("LC") amino acid sequence |
| Ab 733 | 1465 | EVQLVESGGGLVKPGGSLRLSCAASGFSFSSYRVNWVRQAPGKGLEWVSSITGGSS FIDYADSVKGRFTISRDNAKNSLFLQMNSLRAEDTAVYFCARDSMTTVTNSLAFDI WGQGTLVTVSS | ADI-41449 | Heavy chain variable region ("HC") amino acid sequence |
| Ab 733 | 1466 | QSVLTQPPSVSGAPGQRVTISCTGSSSNIGVGYDVQWYQQLPGTAPKLLIYSNNKR PSGVPDRFSGSKSGTSASLAITGLQAEDEADYYCQSYDRSLSVVFPGGGTKVTVL | ADI-41449 | Light chain variable region ("LC") amino acid sequence |
| Ab 734 | 1467 | EVQLVESGGGLVKPGGSLRLSCAASGFAFSSYGINWVRQVPGKRLEWVSSISGGSS FINYADSVKGRFTISRDNAGNSVYLQMNSLRAEDTAVYFCARESYSGSGSSLNWFDP WGQGTLVTVSS | ADI-41450 | Heavy chain variable region ("HC") amino acid sequence |
| Ab 734 | 1468 | QSVLTQPPSVSGAPGQRVTISCTGSSSNIGAGYDVHWYQQLPGIAPRLVIFGNRNR PSGVPDRISGSKSDTSASLAITGLQAEDEGDYYCQSYDKRLSGWVFGGGTKLTVL | ADI-41450 | Light chain variable region ("LC") amino acid sequence |
| Ab 735 | 1469 | EVQLVESGGGLVQPGGSLRLSCAAAGFTFNNYEMHWVRQAPGKGLEWVSCVTSS GTATYYADSVKGRFTVSRDNAKKSLQLQMNSLRAEDTAVYYCARELYLGEDYYYGL DVWGQGTTVTVSS | ADI-41451 | Heavy chain variable region ("HC") amino acid sequence |
| Ab 735 | 1470 | SYELTQPPSVSVSPGQTASISCSGDKLRNKHTCWYQHKSGQSPVLLIYQDNRRPSGI PDRLSGSKSGTTATLTISWTQAMDEAEYYCQAWDSNSAVIFGGGTKLTVL | ADI-41451 | Light chain variable region ("LC") amino acid sequence |
| Ab 736 | 1471 | QVQLVQSGAELKKPGASVKVSCKASGHTFATYAIHWVRQAPGQSLEWLGWINTA NGDTKYSQKFRATVTIHGDTSANTVYLELSRLRSEDTAVYYCASPPLVGAINLEFWG PGILVTVSS | ADI-41452 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 736 | 1472 | QSVLTQPASVSGSVGQSITISCTGTSSDVGGYNSVSWYQHPDKAPKLLIYEVSNRP SGVSHRFSGSKSGNTASLTISGLQAEDEADYYCSSYTTSDTLIFGGGTKVTVL | ADI-41452 | Light chain variable region ("LC") amino acid sequence |
| Ab 737 | 1473 | QVQLVQSGAEVRKPGASVKVSCKASGYTFSIYDMNWVRQAPGQGLEWMGWM NPNSGNTGYAQKFQGRVTMTGDTSISTAYMELSSLTSEDTAVYYCAVMYGDYPGY WGQGSLVTVSS | ADI-41453 | Heavy chain variable region ("HC") amino acid sequence |
| Ab 737 | 1474 | SYELTQPLSVSVALGQTARITCGGNNIGSKSVHWYQQKPGQAPVLVIYRDAKRPSGI PERFSGSNSGNTATLTISGAQAEDEADYYCQVWDSNAWIFGGRTKLTVL | ADI-41453 | Light chain variable region ("LC") amino acid sequence |
| Ab 738 | 1475 | QVQLVQSGAEVKKPGASVKVSCKASGYTFTHFGISWVRQAPGQGLEWMGWISIY NGNTNYAQKIQGRATMTTDASTSTAYMELRSLTSDDTAVYYCAREPPSTTAAATSD YWGQGTLVTVSS | ADI-41454 | Heavy chain variable region ("HC") amino acid sequence |
| Ab 738 | 1476 | DIVMTQSPLSLPVTLGQPASISCRSSQSLVVIEGNTYLSWFQQRPGQSPRRLIYKVSN RDSGVPDRFSGSGSGTDFTLKISRVEAEDVGLIYYCMQGTHWPRTFGQGTKLEIK | ADI-41454 | Light chain variable region ("LC") amino acid sequence |
| Ab 739 | 1477 | QVQLQESGPGLVKPSQTLSLTCSVSEGSVISGDYYMSWIRQSPGKGLEWLGYIHYS GSTYYNPSLKSRVTIISVDTSKKQFSLKLSSVTAADTAVYYCARDLGCIGGVCSAYGLE HNYYFGMDVWGQGTTVTVSS | ADI-41455 | Heavy chain variable region ("HC") amino acid sequence |
| Ab 739 | 1478 | EIVLTQSPATLSLSPGERATLSCRASQSVSSYLAWYQQKPGQAPRLLIYTASNRATGI PARFSGSGSGTDFTLTISSLEPEDFAVYYCQQRSSMPPYTFGQGTKLEIK | ADI-41455 | Light chain variable region ("LC") amino acid sequence |
| Ab 740 | 1479 | EVQLLESGGGLFHPGGSLTLSCVASGFTLSTYYMHWVRQAPGKGLVWVARINSDG GYTTYADSVKGRFTVSRDNAKNTLYLQMNSLRVEDTAVYYCAREWVEFDSWGQG TLVTVSS | ADI-41456 | Heavy chain variable region ("HC") amino acid sequence |
| Ab 740 | 1480 | NFMLTQPHSVSASPGKTVTISCTRSSGNIASNYVQWYQQRPGSSPTTVITEDNQRP SGVPDRFSGSIDSSSNSASLTISGLKTEDEADYYCQSYDSSTYVFGTKLTVL | ADI-41456 | Light chain variable region ("LC") amino acid sequence |
| Ab 741 | 1481 | EVQLVESGGGLVRPGGSLRVSCAASGFTFIRYDMHWVRQAPGKGLEWVSGIGTA GDTYYAASVQGRFTISRENAKNSLYLQMSNLRPGDTAVYYCAGSMAATGIDQWG QGTLVTVSS | ADI-41457 | Heavy chain variable region ("HC") amino acid sequence |
| Ab 741 | 1482 | EIVMTQSPLTLPVTPGEPASISCRSSQSLLHSNGFTYLDWFLQKPGQSPQLLIFLGSN RASGVPDRFSGSGSGTDFTLKISRVEAEDVGIYYCMQALQTPYTFGQGTKVEIK | ADI-41457 | Light chain variable region ("LC") amino acid sequence |
| Ab 742 | 1483 | EVQLLESGGGLVKPSQTLSLTCAVSGDSLNSALYSWSWIRQPPGKGLEWIGYIYYSG STYYNSSLKSRVTISIDRSKNQFSLNLNSVTAADTAVYYCASLQTGYSSGWPFDFWG PGILVTVSS | ADI-41458 | Heavy chain variable region ("HC") amino acid sequence |
| Ab 742 | 1484 | EIVLTQSPGTLSLSPGERATLSCRASQSVSRTYLTWYQQKPGQAPRLLIYGASNRATG IPDRFSGSGSGTDFTLTISRLEPEDFAVYYCQQYGSTPLFGQGTKVEIK | ADI-41458 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 743 | 1485 | QVQLVQSGGGLVQPGGSLRLSCAASGFPFSAYGIMWVRQAPGKGLEWVSYISSTST TIKYADSVKGRFTISRDDAKNSLYLQLRSLRPEDTAVYYCAGGVWSGYIDFWGQG TPVTVSS | ADI-41459 | Heavy chain variable region ("HC") amino acid sequence |
| Ab 743 | 1486 | NFMLTQPQSVSESPGKTVTISCTRSSGSIGSNFVQWYQQRPGSSPTTVIYEDYQRPS GVPDRFSGSIDSSSNSASLTISGLKTEDEADYYCQSYDADMMVFGGGTKLTVL | ADI-41459 | Light chain variable region ("LC") amino acid sequence |
| Ab 744 | 1487 | QVTLKESGPALVKPTQTLTLTCTFSGFSLNTRGMCVSWRQPPGKALEWLARIDW DDDKNYSTSLRTRLTIISKDTSRNQVLAMANMDPVDTATYYCARCARYDRSGYYV WYLDSWGQGTLVTVSS | ADI-41460 | Heavy chain variable region ("HC") amino acid sequence |
| Ab 744 | 1488 | DIQMTQSPSSLSASVGDRVTITCRASQTIASYLNWYQQKPGKAPKLLIYASTLQSG VPSRFSGSGSGTDFTLTISSLQPEDFATYYCQQSYSLTQWTFGQGTKVEIK | ADI-41460 | Light chain variable region ("LC") amino acid sequence |
| Ab 745 | 1489 | QVQLVQSGAEVKKPGASVKVSCRASGYTFSSYDINWVRQATCGQLEWMGWMS PNSANTGYAQKFQGRVIMIRDTSINTAYMELSLSSEDTAVYYCARFLGYCSGGSC YPGYGMDVWGQGTTVTVSS | ADI-41461 | Heavy chain variable region ("HC") amino acid sequence |
| Ab 745 | 1490 | EIVLTQSPDSLAVSLGERATINCKSSQNVLYSSNNKDYLSWYQQKPGQPPKLLIYWA STRESGVPDRFSGSGSGTDFTLTINSLQAEDVAVYYCQQYYGTPYTFGQGTKLEIK | ADI-41461 | Light chain variable region ("LC") amino acid sequence |
| Ab 746 | 1491 | QVQLQQWGAGLVKPSETLSLSCDVYGGSFSGYWTWIRQPPGKGLEWIGEINHS GRTNYNPSLKNRVTISVDTSKKQFSLKLSSVTAADTAVYFCARAPYDIVDYNITTA YFYGMDVWGQGTTVTVSS | ADI-41462 | Heavy chain variable region ("HC") amino acid sequence |
| Ab 746 | 1492 | DIQMTQSPSSLAVSLGERATINCRSSQSVLYSSNNKNYLTWYQQKPGQYNTPLTFGGGTKVEIK ASTRESVPDRFSGSGSGTDFSLTISLQAEDVAVYYCQQYNTPLTFGGGTKVEIK | ADI-41462 | Light chain variable region ("LC") amino acid sequence |
| Ab 747 | 1493 | QVQLVQSGAEVKKPGASVKVSCTASGYSFTDYDISWVRQAPGQGLEWMGWISAY NGNTNYAQKFQDRVTMNTDTSTNTAYMELRGLRSDDTAVYYCARNCYYGSGTCYI EDYYFDYWGQGTLVTVSS | ADI-41463 | Heavy chain variable region ("HC") amino acid sequence |
| Ab 747 | 1494 | DIQMTQSPSSLSASVGDRVTITCRASQDIKNDLGWYQQKPGKPPPKRLIYGASRSQS GVPSRFSGSGSGTDFTLTIYSLQPEDFATYYCLQHSDYPFTFGQGTRLEIK | ADI-41463 | Light chain variable region ("LC") amino acid sequence |
| Ab 748 | 1495 | QVQLVESGPGLVRPSGTLSLLICTVSGDSVNSYRWSWIRQSPCKGLEWIGYISYGET NYNPSLKSRVSISVGTSRYQFFLKLSSVTAADTATYYCARDKTTIFGVSHYYFGVDVW GQGTTVTVSS | ADI-41464 | Heavy chain variable region ("HC") amino acid sequence |
| Ab 748 | 1496 | DIVMTQTPLSLPVTPGEPASISCRSSQSLLKSDGYNSLDWYLQRPGQSPQLLIYLGSN RASGVPARFSGSGSGTDFTLKISRVEAEDVGVYYCMQALQTPFTFGPGTKVEIK | ADI-41464 | Light chain variable region ("LC") amino acid sequence |
| Ab 749 | 1497 | QVQLVQSGGGVVQPGRSLRLSCAASGFTFSTDMHWVRQAPGKGLEWVAIISHD GSKQFYADSVKGRFTISRDNSKNTLYLQMNSLRPEDTAMYYCAKDTPSWGLLAEFF RHWGQGTLVTVSS | ADI-41465 | Heavy chain variable region ("HC") amino acid sequence |
| Ab 749 | 1498 | EIVLTQSPDSLAVSLGERATINCKSSQSVLYSSNDKDYLAWYQHKPGQPPKLLIYWA STRESGVPDRFSGSGSGTDFTLTISSLQAEDVAVYYCQQYYGTPYTFGQGTKVEIK | ADI-41465 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 750 | 1499 | QVQLVQSGAEVKKPGASVKVSCKASGYTFNFYMHWVRQAPGQGLEWMGWIN PKSGGTSYAQKFQGRVIMTGDTSISTTYMELSRLRSDDTAVYYCARADTGLELDVW GQGTTVTVSS | ADI-41466 | Heavy chain variable region ("HC") amino acid sequence |
| Ab 750 | 1500 | QSALIQPASVSGSPGQSITISCTGTSSDVGGYNYVSWYQQHPGKAPKLLIYDVSKRP SGVSNRFSGSKSGNTASLTISGLQAEDESDYFCSSYTRSNTVVFGGGTKVTVL | ADI-41466 | Light chain variable region ("LC") amino acid sequence |
| Ab 751 | 1501 | EVQLVESGGGLVKPGGSLRLSCAASGFSSYINMNWVRQAPGKGLEMVSSISGGS SFVNYADSVKGRFTISRDNAKNSLYLQMSSLKAEDTAIYYCARDPVYCSAASCSAYF DSWGQGSLVTVSS | ADI-41467 | Heavy chain variable region ("HC") amino acid sequence |
| Ab 751 | 1502 | QSVLTQPPSVSGAPGQRVTISCTGSSNIGAGYDVHWYQQLPGTAPKLLIYGNNNR PSGVPDRFSGFKSGSSASLAITGLQAEDEADYYCQSYDIGLSDSHVVFGGGTQLTVL | ADI-41467 | Light chain variable region ("LC") amino acid sequence |
| Ab 752 | 1503 | QVQLQQWGAGPLKSSETLSLTCEVYGGPFSGYSWSWIRQPPGKGLEWIGEINHSG STNYNPSLKSRVSFSVDTSKNQFSLKLSSVTAADTAVYYCARGAGFCTSTSCPPGLYY YYGMDVWGHGTTVTVSS | ADI-41468 | Heavy chain variable region ("HC") amino acid sequence |
| Ab 752 | 1504 | SYELTQPLSVSVALGQTARITCGGNNIESKNVHWYQQMPGLAPVMVIYRDTNRPS GIPERFSGSNSGNTATLTISRAQAGDEADYYCQVMDSGTVLFGGGTKLTVL | ADI-41468 | Light chain variable region ("LC") amino acid sequence |
| Ab 753 | 1505 | EVQLVESGGGVVQPGRSLRLSCAASGFTFSSYGMHWVRQAPGKGLEMVAVISYD GSFIKYADSMMGRFTISRDNSKNTLYLQMSSLRPEDTATYYCAKDALIPEYWGQGT LVTVSS | ADI-41469 | Heavy chain variable region ("HC") amino acid sequence |
| Ab 753 | 1506 | QPVLTQPASVSGSPGQSITISCTGTSSDVGGYNYVSWYQKHPDKAPRVIIYEVSNRP SGVSNRFSGSKSGNTASLTISGLQAEDEADYYCCSYTSTSGVVFGGGTKLTVL | ADI-41469 | Light chain variable region ("LC") amino acid sequence |
| Ab 754 | 1507 | QVQLVESGADVKKPGSSVKISCKASGGSFIITNSLSWVRRAPGQGLEWMGGIIPVS GTTTYAQKFLGRVTFTADESTSTAYMELNSLRSEDTAVYYCARFLGTPYPNVHYGM DVWGQGTTVTVSS | ADI-41471 | Heavy chain variable region ("HC") amino acid sequence |
| Ab 754 | 1508 | DIRVTQSPSSLSASVGARVITCRASQSISTYLNWYQEKPGKAPKLLIYAASSLQRGV PSRFSGSGSETTFTLTISSLQPEDFATYYCQQSYTAAYNFGQGTKVEIK | ADI-41471 | Light chain variable region ("LC") amino acid sequence |
| Ab 755 | 1509 | QVQLVQSGAEVKKPGSSVKVSCKASGGTFSSYAISWVRQAPGQGLEWMGRIIPVL DITNYAQKFQGRVTIMADKSTSTAYMELSSLRSEDTAIYYCARETSNFYFYNAMDV WGQGTTVTVSS | ADI-41472 | Heavy chain variable region ("HC") amino acid sequence |
| Ab 755 | 1510 | QPVLTQPPSASGSPGQSVTISCTGTSSDVGGDNYVSWYQQHPGKAPKLLIYEVSKR PSGVPDRFSGSRSGHTASLTVSGLQAEDEADYYCSSYAGRNNLGVFGGGTKLTVL | ADI-41472 | Light chain variable region ("LC") amino acid sequence |
| Ab 756 | 1511 | QVQLVQSGPGLVKPSQTLSLTCAISGDSVSSNSAAMSWIRQSPSRGLEWLGRTYYR SKWYYDHAVSVEGRITINADTSKNHFSLQLNSVTPEDTAVYYCARDPDSGNYFHYY GMDVWGQGTTVTVSS | ADI-41473 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 756 | 1512 | ETTLTQSPATLSLSPGERATLSCRTSQSVSSYLAWYQQKPGQAPRLLIYDASRRATGI PARFSGSGSGTHFTLTITSLEPEDFAVYYCQQRSKMPPYSFGQGTKVDIK | ADI-41473 | Light chain variable region ("LC") amino acid sequence |
| Ab 757 | 1513 | QVQLVQSGAEVKRPGASVKVSCKISGYTFTSHYIIHWLRQAPGQGLEWMGWINPN TGDTKYEQKFQGRVTMTRDTSLSTAYMELRRLRSDDTAVYYCARDSFYAANGYYFV WFDPWGQGALVTVSS | ADI-41474 | Heavy chain variable region ("HC") amino acid sequence |
| Ab 757 | 1514 | DIQMTQSPTSLSASVGDRVTITCRASQSISSYLNWYQQKPGKAPRFLIYAASSLQSG VPSRFRGSGSGTDFTLTISSLQPEDFATYYCQQSYSSPYTFGQGTKVEIK | ADI-41474 | Light chain variable region ("LC") amino acid sequence |
| Ab 758 | 1515 | QVQLQESGPGLVKPSQTLSLTCAISGDSVSSNSAAMNWIRQSPSRGLEWLGRTYYR SKWWTDYAVSVKSRITINPDTSKNQFSLQLNSVTPEDTAVYYCARDPDSGNYFHYY GMDVWGQGTTVTVSS | ADI-41475 | Heavy chain variable region ("HC") amino acid sequence |
| Ab 758 | 1516 | ETTLTQSPATLSLSPGERATLSCRASQSASSYLAWYQQKPGQAPRLLIYDASKRATGI PARFSGSGSGTDFSLTISSLEPEDFAVYYCQLRSKMPPYTFGQGTKVEIK | ADI-41475 | Light chain variable region ("LC") amino acid sequence |
| Ab 759 | 1517 | EVQLLESGGGLVQPGGSLRLSCATSGFRFTRYWMHWVRQAPGKGLEWVARINFD GTTTNYADSVKGRFTVSRDNAKNTLYLQINSLRAEDTAVYFCARDQTFLEWLPFES WGQGTLVTVSS | ADI-41476 | Heavy chain variable region ("HC") amino acid sequence |
| Ab 759 | 1518 | QTVVTQEPSFSVSPGGIVTLICGLTSGSVSTSYYPSWYQQTPGQAPRTLIYNTKTRF SGVPDRFSGSIIGNKAALTITGAQADDESDYYCVLYMSGGMVFGGGTKLTVL | ADI-41476 | Light chain variable region ("LC") amino acid sequence |
| Ab 760 | 1519 | QVQLVQSGAEVKKPGASVRVSCKASGYPFISYYIHWVRQAPGQGLEWMGMINTN GGSTHYAQKFQGRVTMTRDTSTTIYMELSRLKSEDTAYYFCARDNTETVLHGFWS GYGSYLDYWGQGTLVTVSS | ADI-41477 | Heavy chain variable region ("HC") amino acid sequence |
| Ab 760 | 1520 | EIVLTQSPGTLSLSPGGRATLSCRASQSVTSSYLAWYQQRPGQAPRLLIYGASSRAA GIPDRFSGSGSGTDFTLTISRLEPEDFAVYYCQQYGSAPLTFGGGTKLEIK | ADI-41479 | Light chain variable region ("LC") amino acid sequence |
| Ab 761 | 1521 | QVQLVQSGAEVKKPGESLKISCKGSGYSFISYWIGWVRQMPCKGLEWMGIIYPAD SDTRYSPSFQQQVTISVDKSISTAYLQWSSLKASDTGMYYCVRYGVGGTAPRYWG QGTTVTVSS | ADI-41479 | Heavy chain variable region ("HC") amino acid sequence |
| Ab 761 | 1522 | NFMLTQPHSVSESPGKTVTISCTGSSGSIASNYVHWYQQRPGSAPTTVIYEDNQRP SGVPDRFSGSIDSSSNSASLTISGLKTEDEADYYCQSYDISNLWVFGGGTKLTVL | ADI-41480 | Light chain variable region ("LC") amino acid sequence |
| Ab 762 | 1523 | EVQLLESGPGLVRPSGTLSLTCTVSGDSISGSNWAWVRQPPGRRLEWIGEIYYRG ATDYNSLKSRVIISVDNSKNQFSLNLRSVTAADTAIYYCARVEKFATSGYYISYFDYW GQGTLVTVSS | ADI-41480 | Heavy chain variable region ("HC") amino acid sequence |
| Ab 762 | 1524 | DIRVTQSPSSLSASVGDRVTITCRASQSISTYLNWYQHNPGKAPKLLIYAASSLQSGV PSRFSGSGSGTHFTLTISSLQPADFSTYYCQQSYSSPWTFGQGTKVEIK | ADI-41481 | Light chain variable region ("LC") amino acid sequence |
| Ab 763 | 1525 | QVQLVESGPGLVKPSETLSLACSVSGVSISTYYWTMIRQPPGKGLEMIGYISYSGST NYNPSLKSRVTISADTSKNQFSLRLNSVTAADTAVYYCARTYDFWSTYYGEFDHW G | | Heavy chain variable region ("HC") amino acid sequence HGTLVTVSS |

TABLE 5-continued

Informal Sequence Listing

| Antibody No. | SEQ ID NO: | Sequence | Clone # (ADI) | Descriptors |
|---|---|---|---|---|
| Ab 763 | 1526 | SYELTQPLSVSVALGQTARITCGGNNIESKNVHWYQQKPGQAPVVMYRDTNRPS GIPERFSGSNSGNTATLTISRAQAGDEADYYCQVWDSGTAGVVFGGGTKVTVL | ADI-41481 | Light chain variable region ("LC") amino acid sequence |
| Ab 764 | 1527 | QVQLVQSGAEVKKPGSSVKVSCKASGGTFGSYTINWVRQAPGQGLEWMGGIIPIF GATNYAQNFQGRVSITADKSTATAYMDLISLRSEDTAVYYCARLGRSSPLNSCTTTS CYFWGRGMDVWGQGTTVTVSS | ADI-41482 | Heavy chain variable region ("HC") amino acid sequence |
| Ab 764 | 1528 | QSVLIQPASVSGSPGQSITISCTGTIISDVGIYNYVSWYQQHPGKAPKLIISDVSDRPS GVSNRFSGSKSGITASLTITGLQAEDEADYYCSSYSSSTLYVFGTGTKLTVL | ADI-41482 | Light chain variable region ("LC") amino acid sequence |
| Ab 765 | 1529 | EVQLVESGPGLVKPSEALSLTCTVSGASISSYYWTWIRQSPRKGLEWIGYIYHTGRTN YNPSLKRRVTMSVDWSKNQFSLTLSSVTAADTAVYYCARLKVVPAALESAILEHHFG LDVWGQGTTVTVSS | ADI-41484 | Heavy chain variable region ("HC") amino acid sequence |
| Ab 765 | 1530 | DIVMTQTPSTLSASIGDRVTLTCRASQSINRWLAWYQQKPGKAPKLLIYKASTLESG VPSRFSGSGSGTEFTLTIISGLQPDDFATYYCQQYNNFPYITFGPGTKVDIK | ADI-41484 | Light chain variable region ("LC") amino acid sequence |
| Ab 766 | 1531 | EVQLLESGPGLVRPSETLSLTCTVSGGSLDSGPHVNWNIRQPPGKGLEWIGIYYSV STNYNPSLKSRVTISMDTSKNQFSLNLTSVTAADTAVYYCASFQLIYGPQIWGQGKK VTVSS | ADI-41485 | Heavy chain variable region ("HC") amino acid sequence |
| Ab 766 | 1532 | DIVLTQSPSSVSASVGDRVTITCRASQAISSWLIWSQHKPGKAPKVLIYAASSLQSGV PSRFSGSGSGTDFTLTISSLQPEDFATYYCQQANNFPLTFGGGTKVEIK | ADI-41485 | Light chain variable region ("LC") amino acid sequence |
| Ab 767 | 1533 | QVQLQQWGAGLLKPSETLSLTCCSVYGGSFSGYYWSWIRQPPGKGLEWIGEINHSG STNYNPSLKSRITISVDTSKNQFSLKLNSVTAADTAVYYCARGDYAFVTFDYWGQGT LVTVSS | ADI-41486 | Heavy chain variable region ("HC") amino acid sequence |
| Ab 767 | 1534 | QSVLTQPASVSGSPGQSITISCTGTSTSDVGGYINYVSWYQQHPGKAPKLMIYEVSNR PSGVSNRFSGSKSGNTASLTISGLQAEDEADYYCSSYTSSSTPVFGGGTKLTVL | ADI-41486 | Light chain variable region ("LC") amino acid sequence |
| Ab 768 | 1535 | QVQLVESGGGLVKPGGSLRLSCAASGFTFSTYTMNWVRQAPGKGLEWVSSISGSS AYIYYADSVKGRFTISRDNAKNSLFLQMNSLRAEDTAVYYCARLQGLVLPAVMPSYY YYSGMDVWGQGTTVTVSS | ADI-41487 | Heavy chain variable region ("HC") amino acid sequence |
| Ab 768 | 1536 | EIVMTQSPLSLPVTPGEPASISCRSSQSLLHSNGYNYLDWYLQKPGQSPQLLIYLASN RASGVPDRFSGSGSGTDFTLKISRVEAEDVGVYYCMQALQTPQAFGQGTKVEIK | ADI-41487 | Light chain variable region ("LC") amino acid sequence |
| Ab 769 | 1537 | EVQLVESGPGLVKPSETLSLTCTVSGGSINSDYWNWIRQTPGKGLEWIGYIFYSGNT NYNPSLKSRVTISIDTSKKKFSLQVTSVTAADTAVYYCARMGTLKFDFDNWGQGTL VTVSS | ADI-41488 | Heavy chain variable region ("HC") amino acid sequence |
| Ab 769 | 1538 | QSALTQPRSVSGSPGQSVTIPCTGTSSDVGAYKVSWYQQHPGKAPKLIIYDVTKRP SGVPNRFSGSKSGNTASLTISGLQAEDEADYYCCSYAGTHTYWVFGGGTKVTVL | ADI-41488 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 770 | 1539 | EVQLVESGGGVVQPGRSLRLSCAASGFNFHNYAFHWVRQAPGKGLDWVATYSYD GSSAFYADSVKGRFTISRDNSKKILYLQMTSLRAEDTALYYCARGSSSWSGDYFDYW GQGILVTVSS | ADI-41489 | Heavy chain variable region ("HC") amino acid sequence |
| Ab 770 | 1540 | DIVMTQSPVTLSVSPGERATLSCRASQSVGSNLAWYQQKHGQTPRLLIYDASTRAT SIPARFSGSGSGTEFFLTISSLQSEDFAVYYCQQYNKWPSYTFGQGTKVEIK | ADI-41489 | Light chain variable region ("LC") amino acid sequence |
| Ab 771 | 1541 | EVQLLESGGGLVQPGGSLRLSCAASGFTFSSYSMNWVRQAPGKGLEWVSYMSSD RSAIYYSDSVKDRFTISRDNAKNSLYLQMHSLRAEDTAVYYCARRYCCSSTSCYRGLGY YYGMDVWGQGTTVTVSS | ADI-41491 | Heavy chain variable region ("HC") amino acid sequence |
| Ab 771 | 1542 | SYELTQPPSVSVAPGQTARITCGGSNIGNKDVHWYQQKPGQAPVLVVYDDSDRPS GIPERFAGSNSGNTATLTISRVEAGDEADYYCQVWHSAGDHVVFGGGTKLTVL | ADI-41491 | Light chain variable region ("LC") amino acid sequence |
| Ab 772 | 1543 | QVQLVQSGAEVKPGSSVKVSCKASGGTFNSFVISWVRQAPCQGLEWMGRIIPIL ATVDYAQKFQGRVTITADKSTTTAYMELSGLTSEDTAVYYCARDPPRWDTTMADY YYQGMDVWGQGTTVTVSS | ADI-41492 | Heavy chain variable region ("HC") amino acid sequence |
| Ab 772 | 1544 | DIRVTQSPASLSAFVGDRVTISCRASQSIGSFLNWYQQKPGKAPKLLIYAASSLQSGV PSRFSGSGSGTDFTLAISSLQPEDFATYYCQQSYRSTPTFGGGTKVEIK | ADI-41492 | Light chain variable region ("LC") amino acid sequence |
| Ab 773 | 1545 | QVQLVQSGAEVKKPGESLKISCKGSGYSFTKYWIGWVRQLPGKGLEWMGIIYPGD SETIYSPSFQGQVTISADKSVSTAYLQWSSLKASDTAMYYCARQTFVFWGESHDAF DIWGQGTTVTVSS | ADI-41493 | Heavy chain variable region ("HC") amino acid sequence |
| Ab 773 | 1546 | QPVLTQPPSASGSPGQSVTISCTGTSSDVGAHNYVSWYQHPGKAPKLMIYEVSK RPSGVPDRFSGSKSGNTASLTVSGLQAEDEADYYCCSSYAGSNNWVFGGGTKLTVL | ADI-41493 | Light chain variable region ("LC") amino acid sequence |
| Ab 774 | 1547 | EVQLVESGGGLVQPGRSLRLSCTTSGFTFGDYAVTWVRQAPGKGLEWIGIMKSKTY RGTTDYAASLRGRFSISRDDSKSIAYLQMTSLKSEDTGVYYCVRGHDYGDPFDYWG QGTLVTVSS | ADI-41494 | Heavy chain variable region ("HC") amino acid sequence |
| Ab 774 | 1548 | QSVLTQPASVSGSPGQSITISCTGGSSDVGYNYVSWYQQHPGKAPKLLIYDVNNR PSGVSDRFSGSKSGNTASLTIISGLQPEDEADYYCSSYTRSRTWVFGGGTKLTVL | ADI-41494 | Light chain variable region ("LC") amino acid sequence |
| Ab 775 | 1549 | QVQLVQSGGGLVEPGGSLRLSCAASGFTFSNTWMNWVRQAPGKGLTWVGRIKR KTDFGTSDYAAPVKGRFTISRDDSKNMVFLQMNSLKIEDTGVYYCTTHPRPYLDTT AVVYWGQGTLVTVSS | ADI-41495 | Heavy chain variable region ("HC") amino acid sequence |
| Ab 775 | 1550 | QPVLTQPHSVSESPGKTVTISCIGSSGSITSNYVQMFQQRPGSAPTTVIYEDDQRPS GVPDRFSGSIDSSSNSASLTISGLKTEDEADYYCQSYHHTNPWVFGGGTKLTVL | ADI-41495 | Light chain variable region ("LC") amino acid sequence |
| Ab 776 | 1551 | QVQLVQSGAEVKKPGASVKVSCKASGYTFTSDDIINWVRQATGQGLEWMGWMN PNSGDTGYAQKFQGRVTMTRDTSISTAYMELSSLRSEDTAVYYCARVRIQCSGGRC SYWFFDLWGRGTLVTVSS | ADI-41496 | Heavy chain variable region ("HC") amino acid sequence |
| Ab 776 | 1552 | QSALTQPASVSGSPGQSITISCIGTSSDVGNYNLVSWYQHHPGKAPKVMIYEVNER PSGVSNRFSGSKSGNTASLTIISGLQAEDEADYYCCSSYAGRSTWVFGGGTKLTVL | ADI-41496 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 777 | 1553 | QVQLVESGGGVVQPGRSLRLSCAASGFTFSNHAMHWVRQAPGKGLEMLSFISYD GGVNFYRDSVKGRFTISRDNSKNTLYLQMSSLRPEDTAVYYCARDRVGRVVGASYY LDYWGRGALVTVSS | ADI-41497 | Heavy chain variable region ("HC") amino acid sequence |
| Ab 777 | 1554 | QSVVTQPPSVSVAPGQTASITCGGKHIGSKSVHWYQQKPGQSPVLVVHDDSDRPS GILERFSGSNSGNTATLTINRVEAGDEADYYCQVWDNASDHPYVFGPGTKVTVL | ADI-41497 | Light chain variable region ("LC") amino acid sequence |
| Ab 778 | 1555 | EVQLLESGGGLVKPGGSLRLSCAASGFIFSDYAMNWVRQTPGKGLEMVSSISDSSA YKYYTGSVSGRFTISRDNAKNSLYLQMNDLRPEDTAVFYCARGQWRCSGASCYSPF DSWGQGTLVTVSS | ADI-41498 | Heavy chain variable region ("HC") amino acid sequence |
| Ab 778 | 1556 | SYELTQPPSVSVAPGQTARIPCGGNNIESKNVHWYQQKPGQAPVLVVYDDSDRPS GIPERFSGSNSGSTATLTISRVEAGDEADYYCHVWHRSGDLREVFGSGTKVTVL | ADI-41498 | Light chain variable region ("LC") amino acid sequence |
| Ab 779 | 1557 | EVQLLESGGVVVQPGGSLRLSCAASGFSFDDYTMWVRQAPEKGLEWISLISWNG GVTYYPDSVKGRFTVSRDNNKNSLYLQMDSLRPEDSAFYYCAKESLESSGHFLDYW GQGTLVTVSS | ADI-41499 | Heavy chain variable region ("HC") amino acid sequence |
| Ab 779 | 1558 | QPVLTQSRSVSGSPGQSVTISCIGTNSDVGGYHYVSWFQHPGKAPKLMIYDVSRR PSGVPARFSGSKSGNTASLSISGLRAEDEADYYCCSFAGTYTPYVFGTGTKLTVL | ADI-41499 | Light chain variable region ("LC") amino acid sequence |
| Ab 780 | 1559 | QVQLVQSGAEVKKPGSSVKVSCKASSGIFSDFAISWVRQAPGQGLEMMGGIITIIG TPEYAQKFQGRVRITADESTTTVFMELSRLTSEDTAVYYCARDSRYGSGWYWDHW GQGTLVTVSS | ADI-41501 | Heavy chain variable region ("HC") amino acid sequence |
| Ab 780 | 1560 | DIVMTQTPDSLAVSLGERATINCKSSQSVLYISNNKNYLAWYQQKPGQPPKLLIYW ASTRDSGVPDRFSGSGSGTDFTLSISSLQPEDVAVYYCQQYYDTPRTFGQGTKLEIK | ADI-41501 | Light chain variable region ("LC") amino acid sequence |
| Ab 781 | 1561 | QVQLVQSGAEVKKPGSSVKVSCKASGGPFSSDAMSWVRQAPGQGLEMMGGIIPI LGSATYAQKFKGRVTIAADESTSTSYMELSGLKYEDTAVYYCARPFYDPLTGYFDTFN VWGQGTTVTVSS | ADI-41502 | Heavy chain variable region ("HC") amino acid sequence |
| Ab 781 | 1562 | QSVLTQPRSVPGSPGQSVTISCTGTSGDVGGYNYVSWYQQHPGKAPKLVIYDVTK RPSGVPDRFSGSKSGNRASLTISGLQAEDEADYYCCSYAGSQTGVVFGTGTKVTVL | ADI-41502 | Light chain variable region ("LC") amino acid sequence |
| Ab 782 | 1563 | EVQLLESGGGLVQPGGSLRLSCAASGFTFSDFPLSWVRQAPGKGLVWVSAISSSGG DTYYADSVKGRFTISRDSSKNALYLQMNSLRAEDTAVYYCAKGQELLRPYYYGMDV WGQGTTVTVSS | ADI-41503 | Heavy chain variable region ("HC") amino acid sequence |
| Ab 782 | 1564 | QSALIQPASVSGSPGQSITISCTGTSSDVGGYINFVSWYQQHPGKAPKLMIPEVSNR PSGVSHRFSGSKSGNTASLTISGLQAEDEADYYCSSCTSRFTYVFGTGTKLTVL | ADI-41503 | Light chain variable region ("LC") amino acid sequence |
| Ab 783 | 1565 | EVQLLESGPGLLKTSETLSLTCTVSDGSISGYVWTMIRQPPGKGLECIGYISYSGSTNY SPSLKSRVTISVDTSKNQFSLKLSSVTAADTAVYYCAKIGGYCNPTKCYGWFDPWGQ GTLVTVSS | ADI-41504 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 783 | 1566 | QPVLTQPPSVSGAPGQRVTISCTGSSSNIGAGYDVHWYQQLPGTAPKLLIFGNTNR PSGVPDRFSGSKSGTSASLAITGLQAEDEAAYYCQSYDSSLFYVVLGGGTKLTVL | ADI-41504 | Light chain variable region ("LC") amino acid sequence |
| Ab 784 | 1567 | QVQLQQSGAGLLKPSETLSLTYVVYGGSFSGYYWSWIRQPPGKGLEWMVGDINHST TNYNPSLESRITISIDTSKNQFSLNLSSVTAADSAVYYCARGPKECTSSSCDRFGVDY FYYGMDVWGRGTTVTVSS | ADI-41505 | Heavy chain variable region ("HC") amino acid sequence |
| Ab 784 | 1568 | QSVLTQPPSVSGAPGQRVTISCTGSSANIGAGYDVHWYQQFPGTAPKLLIFGNSNR PSGVPDRFSGSKSGTSASLAITGLQAGDEADYYCQSYDGTLGGWVFGGGTQLTVL | ADI-41505 | Light chain variable region ("LC") amino acid sequence |
| Ab 785 | 1569 | QVTLKESGPTLVKPTQTLRLTCTFSGFSLNVLSGVGVGWIRQPPGKALEWLALIYWD DDKRYSPSLKSRLTIAKDTSKNQVVLTMTNMDPVDTATYYCAHKGGSIEAAVGFDY WGQGTLVTVSS | ADI-41507 | Heavy chain variable region ("HC") amino acid sequence |
| Ab 785 | 1570 | QSVLTQPPSVSGAPGQRVIISCTGSSSNIGAGFAVHWYQQLPGTAPKLLIYANTNRP SGVPDRFSGSKSGTSASLAITGLQAEDEADYYCQSYDTSLSGFYVFGTGTKLTVL | ADI-41507 | Light chain variable region ("LC") amino acid sequence |
| Ab 786 | 1571 | QVQLVQSGAEVRKPGASVKVSCKASGYGFRSYDLTWVRQAPGKGLEWMGWISAY SGGTNYAQTLQGRVTMTTDTSTSTAYMELRSLGPDDTAVYYCARAGLYGSGSPDG FDSWGQGTLVTVSS | ADI-41508 | Heavy chain variable region ("HC") amino acid sequence |
| Ab 786 | 1572 | SYELTQPSVSVSPGQTASITCSGDKLGDKYASWYQQRPGQSPVLVISQDTKRPSGI PERFSGSGSTGNTAILTISGTQAMDEADYYCLAWDSSTAWVFGGGTKLTVL | ADI-41508 | Light chain variable region ("LC") amino acid sequence |
| Ab 787 | 1573 | QVQLVESGGGLVQPGGSLRLSCAASGFTFSDYAMSWVRQAPGKGLVMVSSISGS GKFTYYEDSLRGRVTISRDNSKNTVYLHMNSLRTEDTALYYCARLRIPVINEVDGAM DVWGQGTTVTVSS | ADI-41515 | Heavy chain variable region ("HC") amino acid sequence |
| Ab 787 | 1574 | SYELTQLPSVSVSPGQTARITCSGDALPKKFAYWQQKSGQAPVLVIYEDTGRPSGI PERFSGSTSGTTATLTINGAQVEDEGDYYCYSADSSDNQGVFGGGTKVTVL | ADI-41515 | Light chain variable region ("LC") amino acid sequence |
| Ab 788 | 1575 | EVQLLESGPRLVKPSETLSLTCIVSGGFISYDYWSWIRQPAGKGLEWIGRIYAGGIPK YNPSLKSRVIMSLDMSNNQFSLRLKSVTAADSAVYYCARAEPCSGDCFLGENPFDS WGQGTLVTVSS | ADI-41516 | Heavy chain variable region ("HC") amino acid sequence |
| Ab 788 | 1576 | QSVLTQPPSASGTPGQRVTISCSGSSSSIGSNYVIVNWYQQLPGTAPKLLIHKDNERPS GVPDRFSGSKSGTSASLAISGLRSEDEGDYSCAAWDDSLSGWVFGGGTKLTVL | ADI-41516 | Light chain variable region ("LC") amino acid sequence |
| Ab 789 | 1577 | QVQLVQSGGGLVQPGGSLRLACAASGFTLSGYAMMWVRQAPGKGLEMVSSISGS GGSTYYADSVKGRFTTSRDNSKNTVFLHMNSLRAEDTAIYYCATVPWETGPFDHW GQGTLVTVSS | ADI-41517 | Heavy chain variable region ("HC") amino acid sequence |
| Ab 789 | 1578 | QSVLTQPPSVSGAPGQRVTISCTGSSSNIGAGYAVHWYQQLPGTAPKLLIHGTTNR PSGVPDRFSGSKSGTSASLAITGLQAEDEADYYCQSYDSRLSGYVFGTGTKLTVL | ADI-41517 | Light chain variable region ("LC") amino acid sequence |
| Ab 790 | 1579 | EVQLVESGGGLVKPGGSLRLSCAASGFTFSSYSMNWVRQAPGKGLEMVSSISSSSS YINYADSVKGRFTISRDNAKNSLYLQMNSLRAEDTALYYCARDLGYCSDTSCTPGIG YWGQGTLVTVSS | ADI-41518 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 790 | 1580 | QPVLTQPPSVSGAPGQRVTISCTGSSNIGAGYDVHWYQQLPGTAPKLLIYGNSNR PSGVPDRFSGSKSGTSASLAITGLQAEDEADYYCQSYDSGLSPWVFGGGTKLTVL | ADI-41518 | Light chain variable region ("LC") amino acid sequence |
| Ab 791 | 1581 | QVQLVESGPGLVKPSETLSLTCNVSGGSIIISGSYWGWIRQPPGKGLTWIGSISYSG TTYYNPSLRSRLTISLDTSRNHFSLQLTSVSAADTAVYYCARAFYEWTGSEIPGDFD RWGQGTLVTVSS | ADI-41519 | Heavy chain variable region ("HC") amino acid sequence |
| Ab 791 | 1582 | EIVLTQSPGTLSLSPGERATLSCRASQSVSSSYLAWYQQKPGQAPRLLIYGASSRAIDI PDRFSGSGSGTDFTLTISRLEPEDFAVYYCQQFRRSPWTFGQGTKVDIK | ADI-41519 | Light chain variable region ("LC") amino acid sequence |
| Ab 792 | 1583 | EVQLLESGGGVVRPGGSLRLSCAASGFSFDDYGMTWVRQAPGKGLEMVSGINW NGISTDYADSVKGRFTISRDNAKNSVVLQMNSLRAEDTALYYCARIGGVVIASTAY YYGMDVWGQGTTVTVSS | ADI-41520 | Heavy chain variable region ("HC") amino acid sequence |
| Ab 792 | 1584 | DIQLTQSPSSLSAYVGDRVTITCRASQSIRNHLNWYQQKPGKAPQLLIYTASSLQDG VPSRFSGSGSGTDFTLAISSLQPEDFATYYCQQSHSMPPITFGQGTRLEIK | ADI-41520 | Light chain variable region ("LC") amino acid sequence |
| Ab 793 | 1585 | EVQLVESGGGLVQPGRSLRLSCAASGFTFDDFAMDWVRQPGKGLEWVSGISWN GVSKDYAGSVKGRFTISRDNAKNSLYLQMNSLRAEDTALYFCAKARRDVINWGDA FDIWGQGTMVTVSS | ADI-41521 | Heavy chain variable region ("HC") amino acid sequence |
| Ab 793 | 1586 | DIRLTQSPGTLSLSPGERATLSCRASQPLNSNYLAWRQKPGQAPRLLIFDASSRAT GVPDRISGSGSGTDFTLTVSRLEPEDIAVYYCQQYASSPWTFGLGTKVEIK | ADI-41521 | Light chain variable region ("LC") amino acid sequence |
| Ab 794 | 1587 | QVQLVQSGAEVKKPGSSVKVSCKASGGTFNNFPISWVRQAPGQGLEMMGGIIPM FGRANYAQKFQGRVTITADESTTTVMALRLSRSEDTAVYYCARPDYDVLTGFEGA FDIWGQGTMVTVSS | ADI-41522 | Heavy chain variable region ("HC") amino acid sequence |
| Ab 794 | 1588 | QSALTQPASVSGSPGQLITISCTGTSRDVGGYNYVSWYQQHPGKAPKLMIYDVTNR PSGVSNRFSGSKSGNTASLTISGLQSEDEADYYCSSYTSTTTWVFGGGTKLTVL | ADI-41522 | Light chain variable region ("LC") amino acid sequence |
| Ab 795 | 1589 | QVQLVQSGAEVKKPGESLRISCKGSGDTFSNYWIGWVRQMPGKGLEMMGIIYPG DSDTRYSPSFQGQVTFSADKSISTAYLQWSSLKASDTAMYCVRQYGGVVTDTD NYYYGMDVWGQGTTVTVSS | ADI-41523 | Heavy chain variable region ("HC") amino acid sequence |
| Ab 795 | 1590 | DIRLTQSPSSLSASVGDRVTITCRASQSIRSYLNWYQQKPGKAPKLLIYSASSLQSGVP SRFSGSGSGTDFTLTISSLQPEDFATYYCQQSHSTPLITFGPGTKVDIK | ADI-41523 | Light chain variable region ("LC") amino acid sequence |
| Ab 796 | 1591 | EVQLVESGGGLVQPGRSLRLSCTGSGFTFGDYAISWFRQAPGKGLEMVGFIRSKPY GGTTEYAASVKGTFTISRDDSKSIAYLQMNSLKTGDTAVIFPCTRGLIWGITMIVPWSD PWGQGTLVTVSS | ADI-41524 | Heavy chain variable region ("HC") amino acid sequence |
| Ab 796 | 1592 | DIVMTQTPLSLPVTPGEPASISCRSSQSLLHSNGFNVLAWYLQKPGQSPQLLIYLNSN RASGVPDRFSGSGSGTDFTLKISRVEAEDVGVYYCMQALQTPLTFGPGTKLEIK | ADI-41524 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 797 | 1593 | QVQLVQSGAEMKKPGSSVKVSCKASGRTFKYFALNMWRRAPGHGLEMIGDIPIS GSTNYAQKFQGRVTITADESASTAYMEVSRLRSDDTAVYYCASLHYDVSTGFSDAF DIWGQGTMVTVSS | ADI-41525 | Heavy chain variable region ("HC") amino acid sequence |
| Ab 797 | 1594 | QSVLTQPASVSGSPGQSITISCTGTSSDVGAYNYVSWYQHHPGKAPKLMIFDVSNR PSGVSNRFSGSKSGNTASLTISGLQAEDEADYYCSSYRSTFSYVFGGTKVTVL | ADI-41525 | Light chain variable region ("LC") amino acid sequence |
| Ab 798 | 1595 | QVQLVQSGAEVKKPGASVKVSCEAASGYTFTDYYMHWVRQAPGQGLEMMGWIN PNSGVTKIAQNFQGRVTMTRDTSITTAYMDLSRLRSDDTAVYYCARVDGDYDN WFDFWGQGTLVTVSS | ADI-41526 | Heavy chain variable region ("HC") amino acid sequence |
| Ab 798 | 1596 | SYVLTQPPSASGTPGQRVTISCSGSTSNIGTNTVNWYQQPPGMAPKLLIYANNQRP SGVPDRFSGSKSGTSASLAISGLQSEDEADYHCAVNDDSLPGWVFGGGTKLTVL | ADI-41526 | Light chain variable region ("LC") amino acid sequence |
| Ab 799 | 1597 | EVQLLESGGLVQPGGSLRLSCAASGFTFTSYWMSWVRQAPGQGLEMVATIKQD GSEKYYVDSVKGRFTISRDNAKNSLYLQMNSLGAEDTAVYYCARDMYCSTTTCYFF ETYYYNGMDVWGQGTTVTVSS | ADI-41527 | Heavy chain variable region ("HC") amino acid sequence |
| Ab 799 | 1598 | DIRLTQSPSSVSASVGDRVTITCRASQVTSTWLAWYQQNPGKAPKLLIYAASRLQSG VPSRFSGSGSGTEFTLTISSLQPEDFATYYCQQANSFPLTFGGGTKVEIK | ADI-41527 | Light chain variable region ("LC") amino acid sequence |
| Ab 800 | 1599 | EVQLVESGGGVVQPGRSLRLSCAASGFTFSSYAMHWVRQAPGKGLEMVAVISFD GSSDYYADSVKGRFTISRDSSKNTLYLRMNSLRAEDTAVYYCARRAVEYSIYNNDAF DVWGQGTTVTVSS | ADI-41528 | Heavy chain variable region ("HC") amino acid sequence |
| Ab 800 | 1600 | SYELTQPPSVSVSPGQTASITCSGDKLGNKFTFWYQQKSGQSPVLVIYQETKRPSGIP ERFSGSNSGNTATLTIISGTQSMDEADYYCQAWDSSTAFFGGGTKLTVL | ADI-41528 | Light chain variable region ("LC") amino acid sequence |
| Ab 801 | 1601 | EVQLVQSGAEVRRPGSSVKVSCKASGGTLDTDSISWVRQVPGQGLVWVGGVIPIL GSVVYARKFQGRVTTIADGSTSTAYMELRSLRSEDTAMYYCASQFYDFRRGYFDAF DIWGQGTTVTVSS | ADI-41529 | Heavy chain variable region ("HC") amino acid sequence |
| Ab 801 | 1602 | ETTLTQSPGILSLSPGERATLSCRATQTVISNYIINWYQQKPGQAPRLLIYGASSRATGI PDRFSGSGSGTDFTLTISRLEPEDFAVYYCQRYDSSPPGFTFGPGTKVDIK | ADI-41529 | Light chain variable region ("LC") amino acid sequence |
| Ab 802 | 1603 | QVQLVESGAEVKKPGASVKVSCRASGYTMTRDTSINTAYMELSSLRSDDTAVYYCAAQLWYPNWGQ NSGNTGYALRFQGRVTMTRDTSINTAYMELSSLRSDDTAVYYCAAQLWYPNWGQ GTLVTVSS | ADI-41530 | Heavy chain variable region ("HC") amino acid sequence |
| Ab 802 | 1604 | SYELTQPPSVSVGLGQTASITCGGNNIGSKSVHWYQQKPGQAPTLVIYRDTNRPSGI PERFSGSNSENTATLTISRAQAGDEADFYCQVSDNYSWVFGGGTKLTVL | ADI-41530 | Light chain variable region ("LC") amino acid sequence |
| Ab 803 | 1605 | EVQLLESGGDLVQPGGSLRLSCAASGFTFSSYALNWVRRTPGKGLEMVSGISGSGG STYYADSVKGRFTISRDNSKSTLYLQMNSLKVDDTAVYFCAKDFQHDYGDPYRSYYF DHWGQGTLVTVSS | ADI-41531 | Heavy chain variable region ("HC") amino acid sequence |
| Ab 803 | 1606 | DIQLTQSPSSLAASVGDRVTITCQASRDIRKSLNWYQVKPGKAPKLLISDASYLETGV PPRFSGSGFGTH FTFTISSLQPEDIATYYCQQYDNLPPPTFGGGTKVDIK | ADI-41531 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 804 | 1607 | QVQLVQSGAEVKKPGESLKISCKGSGYSFTSSWIGWVRQMPGKGLEWMGIIYPGD SDTRYSPSIQRVTISADKSITTAYLQWSSLKASDTATYYCAKFGGYADAYFYHGMD VWGQGTTVTVSS | ADI-41532 | Heavy chain variable region ("HC") amino acid sequence |
| Ab 804 | 1608 | SYVLTQPPSASGTPGQRVTISCSGSSSNVGSNTVNWYQQLPGTAPKLLIHFNNQRP SGVPDRFSGSKSGTSASLAISGLQSEDEADYYCAAMDDSLNTWVFGGGTKVTVL | ADI-41532 | Light chain variable region ("LC") amino acid sequence |
| Ab 805 | 1609 | QVQLVESGGGVVQPGRSLRLSCAASGFTFSSYAMHWVRQAPGKGLEMLAVISFD GSSEFYGDSVRGRFTISRDNSKNTLYLRVNSLRAEDTALYYCARRSLKYSMYNNDAF DVWGQGTTVTVSS | ADI-41533 | Heavy chain variable region ("HC") amino acid sequence |
| Ab 805 | 1610 | QPVLTQPPSVSVSPGQTASITCSGDKLGNKFTFWYQQKSGQSPVLVIYQESQRPSGI PERFSGSNSGNTATLTIRGAQAMDEADYYCQAWDSSTAFFGGGTKLTVL | ADI-41533 | Light chain variable region ("LC") amino acid sequence |
| Ab 806 | 1611 | QVQLVQSGGGVVQPGRSLRLSCAASGFTFSNYAMHWVRQAPGKGLEWVTLISYD GSAQDYADSVKGRITISRDNSKNTLYLQMSSLRPEDTAVYYCARYYCTNDVCSSSAL DIWGQGTTVTVSS | ADI-41534 | Heavy chain variable region ("HC") amino acid sequence |
| Ab 806 | 1612 | SYELIQPPSVSVSPGQTASITCSGDKLGNKFTCWYQQKPGQSPVLVIYQDSKRPSGIP ERFSGSNSGNTATLTIISGTQAMDEADYYCQAMDSSTVVFGGRTKLTVL | ADI-41534 | Light chain variable region ("LC") amino acid sequence |
| Ab 807 | 1613 | QVTLKESGPALVKPTQTLTLTCTFSGFSLSTSRMCVSWIRQSPGKALEWLARIDWD DDKFFSTSLKTRLTISKDTSRNQVVLTMTNMDPVDTATYYCARTTVYASGGYYLYF DYWGQGTLVTVSS | ADI-41535 | Heavy chain variable region ("HC") amino acid sequence |
| Ab 807 | 1614 | DIQLTQSPSSLPASVGDRVTITCRASQRIASYLNWYQQKPGKAPKVLIYAASNLQSG VPSRFSGSGSGTDFTLTINSLQPEDFATYYCQQSYTTPWTFGQGTKVEIK | ADI-41535 | Light chain variable region ("LC") amino acid sequence |
| Ab 808 | 1615 | EVQLVESGAGLLKPSETLSLICVVYGGSFSGYYWSWIRQPPGKGLEWVGDINHSTT TNYNPSLESRITISIDTSKNQFSLNLSSVTAADSAVYYCARGPKECTSSSCDRFGVDYF YYGMDVWGRGTTVTVSS | ADI-41536 | Heavy chain variable region ("HC") amino acid sequence |
| Ab 808 | 1616 | QSVLTQPPSVSGAPGQRVTISCTGSSANIGAGYDVHWYQQFPGTAPKLLIFGNSNR PSGVPDRFSGSKSGTSASLAITGLQAEDEADYYCQSYDGTLGGWVFGGGTQLTVL | ADI-41536 | Light chain variable region ("LC") amino acid sequence |
| Ab 809 | 1617 | EVQLLESGGGLVQPGGSLRLSCAASEFTFSRYPMSWVRQAPGKGLEMVSGISVSG DSTYYADSVKGRLTISRDNSKNTLYLQMNSLRAEDTAVYYCAIDHYDTSGYYGMDV WGQGTTVTVSS | ADI-41537 | Heavy chain variable region ("HC") amino acid sequence |
| Ab 809 | 1618 | DIRLTQSPLSLPVTPGEPASISCRSSRSLLRSNGYNYLDWYLQKPGQSPQLLIYLGSNR ASGVPDRFSGSGSGTDFTLKISRVEABDVGVVYCMQALQSSYTFGQQTKLEIK | ADI-41537 | Light chain variable region ("LC") amino acid sequence |
| Ab 810 | 1619 | EVQLVESGGGLVKPGGSLRLSCAASGFTLSTYGVNWVRQAPGKGLEWVSSISSSGN NIHYADSVKGRPTVFRDNAKHSMYLQMNSLRAEDTAVYYCARSLDYSNYYYYGLD VWGQGTTVTVSS | ADI-41538 | Heavy chain variable region ("HC") amino acid sequence |
| Ab 810 | 1620 | EIVLTQSPDSLAVSLGERATINCKSSQSIFYSSNNMNYLAWYQQKAGQPPKLLIYWA STRESGVPDRFSGSGSGTDFTLTISSLQAEDVAVYYCHQYYSIPLTFGGGTKVEIK | ADI-41538 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 811 | 1621 | QVQLVESGAEVKKPGASVKVSCKASGYNFIDYGISWVRQAPGQGLEWVGWISAY NGNTNYAQKLQGRVTMTTDTSTNTAYMELRSLRSDDTALYYCARDSSLHPTYYYY YPMDVWGQGTTVTVSS | ADI-41539 | Heavy chain variable region ("HC") amino acid sequence |
| Ab 811 | 1622 | DIVMTQSPATLSVSPGERATLSCRASQSVSSRLAWYQQKPGQAPRLLIYGASTRAT DVPARFSGSGSGTEFTLTISSLQSEDFAVYYCQQYNNWPPERTFGQGTKVEIK | ADI-41539 | Light chain variable region ("LC") amino acid sequence |
| Ab 812 | 1623 | QVQLQQWGAGLLKPSETLSLTCGVYGSFTGYQWSWIRQSPGKGLEWIGDIDHG GNTNYRPSLKSRIITSVNMSKKEFSLKLASVTAADTAVYYCARGVGFLEFSGGPTGRR RNWFDSWGQGTLVTVSS | ADI-41540 | Heavy chain variable region ("HC") amino acid sequence |
| Ab 812 | 1624 | DIQLTQSPGTLSLSPGEGATLSCRASQSVGGSYLAWYQQRPGQAPRLLIYGASNRA ADSPDRFSGSGSGATDFTLTISRLEPEDFAVYYCQQYGSSPWTFGQGTKVEIK | ADI-41540 | Light chain variable region ("LC") amino acid sequence |
| Ab 813 | 1625 | QITLKESGPTLVKPTQTLTLTCTFSGFSLSSSGVGVGWIRQPPGKALEWLALIYWDD DKRYSPSLKSRLTITKDTSKNQVLTMTNMDPVDTATYYCAHRGPYYYDMSGYYYE AFDIWGQGTTVTVSS | ADI-41541 | Heavy chain variable region ("HC") amino acid sequence |
| Ab 813 | 1626 | SYELMQPPSVSVAPGQTARITCGGNNIGSKGVHWYQQKPGQAPVLVVYDDNDRP SGIPERFSGSNSGNTATLTISRVEAGDEADYYCQVMDSSSDHHYVFGTGTKVTVL | ADI-41541 | Light chain variable region ("LC") amino acid sequence |
| Ab 814 | 1627 | EVQLVESGVAVKKPGESLKISCKGSGYNFDSFWIGWVRQLPGKGLEWMGIIFPGDS DTRYGPSFQGQVTISADKSINTAYLQWRSLKASDTAMYYCARHGLGGYDNSGYNL WGHGTMVTVSS | ADI-41542 | Heavy chain variable region ("HC") amino acid sequence |
| Ab 814 | 1628 | DIVMTQSPSSLSASVGDRVITTCQASHDISTSLNWYQQKPGKAPNLLISDASTLERG VPSRFSGGGSGTEFFTFTISSLQPEDIATYYCQQFENLPITFGQGTRLEIK | ADI-41542 | Light chain variable region ("LC") amino acid sequence |
| Ab 815 | 1629 | QVQLVQSGAEVKKPGASVRVSCKASGYTLTGYIHWLRQAPGQGLEWVGRINPNT GETSYSQKFQGRVIMTRDTSVSTAYVDLSRLRSRDTAVYFCARSDVMITVTAEGDFS YYYYRFDVWGQGTTVTVSS | ADI-41543 | Heavy chain variable region ("HC") amino acid sequence |
| Ab 815 | 1630 | DIVMTQTPLSLPVTPGEPASISCRSSQSLLHSNGHNYLDWYLQKPGQSPQLLIYLGSI RASGVSDRFSGSGSGTDFTLKISRVEAEDVGIYYCMQALQTPHFGGGTKVEIK | ADI-41543 | Light chain variable region ("LC") amino acid sequence |
| Ab 816 | 1631 | QVQLVQSGAEVKKPGESLKISCKGSGYSFTNYWIGWVRQMPGKGLEWMGIIFPA DSDTRYSPSFQGQVTISADKSVSTAYLQWTSLKASDTAIYYCARLGVAAAGGYWGQ GTLVTVSS | ADI-41544 | Heavy chain variable region ("HC") amino acid sequence |
| Ab 816 | 1632 | DIQVTQSPSSLSASVGDRVITCQASQDISNVLNWYQQKPGKAPKLLIHDASTLETG VPSRFSGRGSGTDFTFTISSLQPEDIATYYCQQYDNLPPTFGGGTKVEIK | ADI-41544 | Light chain variable region ("LC") amino acid sequence |
| Ab 817 | 1633 | QVQLVESGPGLVKPSETLSLTCTVSGGSISRYYWSWIRQSPGKGLEWIGYIYHSVLTN YNPSLKSRVTISIDMSKNQFSLKLSSVTAADTAVYYCASRPLINGYGPDNYFDYWGQ GTLVTVSS | ADI-41545 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 817 | 1634 | SYVLTQPPSVSVAPGQTARITCGGNNIGSKSVHWYQRKPGQAPVLVVYDDSDRPS GIPERFSGSNSNTATLTIIRVEAGDEADYYCQVMDNSSDHPVFGGGTKLTVL | ADI-41545 | Light chain variable region ("LC") amino acid sequence |
| Ab 818 | 1635 | QVQLVQSGAEVKKPGESLKISCKGSGYSFTNYWIGWVRQMPGKGLEWMGIIFSAD SDTRYSPSFQGQVTISADKSISTAYLQWSSLKASDTAMYYCARQWGITGDAPDIWG QGTMVTVSS | ADI-41546 | Heavy chain variable region ("HC") amino acid sequence |
| Ab 818 | 1636 | DIQVTQSPSFLSASVGDRVTITCRASQGISGYLAWYQQKPGKAPKLLIYAASTLQSG VPSRFSGSGSGTEFTLTISSLQPEDFATYYCQQLNSYPYTFGQGTKVEIK | ADI-41546 | Light chain variable region ("LC") amino acid sequence |
| Ab 819 | 1637 | QVQLVQSGAEVKKPGSSVKVSCKASGGSFSSNTIINWVRQAPGQGLEWMGGIIPVF ETPNYAQKFQGRVSFTADESTRTAYMELSSLRSEDTAVYFCARQGMSYYDTNGNY YVGWFDIWGQGTLVTVSS | ADI-41547 | Heavy chain variable region ("HC") amino acid sequence |
| Ab 819 | 1638 | EIVLTQSPGTLSLSPGERATLSCRASQSLNNNYLAWYQRKPGQAPRLLIYGAGAFSR ATGIPDRFSGSGSGTDFTLTISRLEPEDFALYYCQQYGSSPLTFGQGTRLEIK | ADI-41547 | Light chain variable region ("LC") amino acid sequence |
| Ab 820 | 1639 | QVQLQQWGPGLVKPSETLSLTCTVSGASITSHYWSWLRQPAGKGLEWIGRFYPSG TTEKTPSLKSRVTLSVDTSKNHFSLKLTSVTAADTAVYYCARDSYDDIAGSEYYFAD WGQGTLVTVSS | ADI-41548 | Heavy chain variable region ("HC") amino acid sequence |
| Ab 820 | 1640 | EIVLTQSPATLSVSPGERATLSCRASQSVSSNLAWYQQKPGQAPRLLIYDLSTRATGV PARFSGSGSGTEFTLTITSLQSEDFTVYYCQQYNMMPPTFGQGTKLEIK | ADI-41548 | Light chain variable region ("LC") amino acid sequence |
| Ab 821 | 1641 | EVQLLESGGGVVQPGGSLRLSCAASGFTFSGYGMHWVRQAPGKGLEWVAFIQYN GSNKYADSVKGRFTISRDNSKNTLYVQLNSLRAEDTAVYYCATDILVVPAATPLLSY YFGMDVWGQGTTVTVSS | ADI-41549 | Heavy chain variable region ("HC") amino acid sequence |
| Ab 821 | 1642 | QSALTQPASVSGSPGQSITISCTGTSSDVGGYINYVSWYQQYPGKAPKLMIYEVTNR PSGVSNRFSGSKSGNTASLTIISGLQAEDEADYYCCSYTSINTRVFGTGTKVTVL | ADI-41549 | Light chain variable region ("LC") amino acid sequence |
| Ab 822 | 1643 | QVQLVQSGAEVKMPGASVRVSCKASGYTLGSHGITWVRQAPGQGLEWMGWISA NNFNTHYAQKFQGRVTMTTDTSTSTAYMELRSLRSDDTAVYYCAREVMGHMVET ISFDYWGQGTLVTVSS | ADI-41550 | Heavy chain variable region ("HC") amino acid sequence |
| Ab 822 | 1644 | QPVLTQPPSVSVAPGQTARITCGGNNIGSESVHWYQQKPGQAPVLVVHDDSDRP SGIPERFSGSNSGNTATLTISRVEAGDEADYYCQVMDFTPDHPVFGGGTKVTVL | ADI-41550 | Light chain variable region ("LC") amino acid sequence |
| Ab 823 | 1645 | QVQLQESGGGVVQPGGSLRLSCAASGFTFSRHMHMHVRQVPGKGLVWVSRINS DESTIDYADSVKGRFTISRDNAKNTLYLQMNSLRAEDTAVYYCVRDMVAVPGTTG GDYWGQGTLVTVSS | ADI-41551 | Heavy chain variable region ("HC") amino acid sequence |
| Ab 823 | 1646 | SYELTQPPSVSVSPGQTADITCSGDKLGDKYACWYQQRAGQSPILVLYQDTRRPSGI PERFSGSNSGDTATLTISGTQAMDEADYYCQAWDSSTAWVFGGGTKLTVL | ADI-41551 | Light chain variable region ("LC") amino acid sequence |
| Ab 824 | 1647 | QVQLVQSGGGLVKPGGSLRLSCAASGFTFSSYSMNWVRQAPGKGLEMVSSISSSS SYIYYADSVKGRFTISRDNAKNSLYLQMNSLRAEDTAVYYCARVLSGYSYGYDYWG QGTLVTVSS | ADI-43643 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 824 | 1648 | QSVLTQPPSVSGAPGQRVTISCTGSSNIGAGYDVHWYQQLPGTAPKLLIYGNSNR PSGVPDRFSGSKSGTSASLAITGLQAEDEADYYCQSYDSSLSGSVFGTKVTVL | ADI-43643 | Light chain variable region ("LC") amino acid sequence |
| Ab 825 | 1649 | EVQLVESGGGLVQPGGSLRLSCAASGFTFSSYAMSWVRQAPGKGLEWVSAISGSG GSTYYADSVKGRFTISRDNSKNTLYLQMNSLRAEDTAVYYCAKDFTVHPLQQLTYY YFDYWGQGTLVTVSS | ADI-43644 | Heavy chain variable region ("HC") amino acid sequence |
| Ab 825 | 1650 | DIVLTQSPATLSLSPGERATLSCRASQSVSSYLAWYQQKPGQAPRLLIYDASNRATGI PARFSGSGSGTDFTLTISSLEPEDFAVYYCQQRSNWPPGFTFGGGTKVEIK | ADI-43644 | Light chain variable region ("LC") amino acid sequence |
| Ab 826 | 1651 | QVQLVQSGAEVKKPGSSVKVSCKASGTFSSYAISWVRQAPGQGLEWMGGIIPIF GTANYAQKFQGRVTITADESTSTAYMELSSLRSEDTAVYYCARGWRGGGMTGSYY YYGMDVWGQGTTVTVSS | ADI-43645 | Heavy chain variable region ("HC") amino acid sequence |
| Ab 826 | 1652 | DIQVTQTPSTLSASVGDRVTITCRASQSISSWLAWYQQKPGKAPKLLIYKASSLESGV PSRFSGSGSGTEFTLTISSLQPDDFATYYCQQHRGTFGQGTKVDIK | ADI-43645 | Light chain variable region ("LC") amino acid sequence |
| Ab 827 | 1653 | EMQLMQSGGVVVQPGGSLRLSCAASGFTFDDYAMHWVRQASGKGLEWVSLIIS WDGGSTYYADSVKGRFTISRDNSKNSLYLQMNSLRAEDTALYYCAKDFDPLVVPAA MCFDYWGQGTLVTVSS | ADI-43646 | Heavy chain variable region ("HC") amino acid sequence |
| Ab 827 | 1654 | QSVLIQPASVSGSPGQSITICTGTSSDVGGYNYVSWYQQHPGKAPKLMIYDVSNR PSGVSNRFSGSKSGNTASLTISGLQAEDEADYYCSSYTSSSTLYVFGTGTKLTVL | ADI-43646 | Light chain variable region ("LC") amino acid sequence |
| Ab 828 | 1655 | EVQLVESGGGLVQLGGPLRLSCAASGFTFSSYAMSWVRQAPGKGLEWVSAISGSG GSTYYADSVKGRFTISRDNSKNTLYLQMNSLRAEDTAVYYCAKGFERDYADAFDIW GQGTTVTVSS | ADI-43647 | Heavy chain variable region ("HC") amino acid sequence |
| Ab 828 | 1656 | DIRMTQSPSSVSASVGDRVTITCRASQGISSWLAWYQQKPGKAPKLLIYAASSLQSG VPSRFSGSGSGTDFTLTISSLQPEDFATYYCQQANSFPITFGQGTRLEIK | ADI-43647 | Light chain variable region ("LC") amino acid sequence |
| Ab 829 | 1657 | EVQLVQSGAEVKKPGASVKVSCKASGYTFTSYDINWVRQATGQGLEWMGWNN PNSGNTGYAQKFQGRVTMTRNTSISTAYMELSSLRSEDTAVYYCATRPAALDYWG QGTLVTVSS | ADI-43648 | Heavy chain variable region ("HC") amino acid sequence |
| Ab 829 | 1658 | QPVLIQPLSVSVALGQTARITCGGNNIGSKNVHWYQQKPGQAPVLIIYRDSNRPSG IPERFSGSNSGNTATLTISRAQAGDEADYYCQVWDSSTWVPGGGTKLTVL | ADI-43648 | Light chain variable region ("LC") amino acid sequence |
| Ab 830 | 1659 | QVQLVQSGGGLVKPGGSLRLSCAASGFTFRDFYMSWIRQAPGKGLEWVSNISPSS TYTNYADSVKGRFTISRDNAKNSLYLQMNSLRAEDTAVYYCVKSEGYSSGWYDYW GQGTTVTVSS | ADI-36673 | Heavy chain variable region ("HC") amino acid sequence |
| Ab 830 | 1660 | QPVLTQPPSVSGAPGQRVTISCTGSSNIGAGYDVNWYHQLPGAAPKLLIYTNSNR PSGVPDRFSGSKSGTSASLAITGLQAEDEADYYCQSYDSSLSGYVFGTGTKLTVL | ADI-36673 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 831 | 1661 | EVQLVESGGGLVQPGGSLRLSCAASGFTENRFAMSWVRQAPGKGLEWVSGISGS GSTLYADSVKGRFTISRDNSKNTLYLQINSLRVEDTAVYYCASRSSYDDVWNGYVD WDWGFDFYYGMDVWGQGTTVTVSS | ADI-36675 | Heavy chain variable region ("HC") amino acid sequence |
| Ab 831 | 1662 | QAVVTQEPSMSAAPGQKVTISCSGGDSNIRNNYVFWYQQLPGTAPKLLIYDNTKR PSGIPGRFSGSKSGASATLDITGLQTGDEADYYCGTWDSSLSALVFGGGTQLTVL | ADI-36675 | Light chain variable region ("LC") amino acid sequence |
| Ab 832 | 1663 | EVQLLESGGGVVQPGRSLRLSCAASGFSFRNYDMHWVRQAPGKGLEWVAIISYDG SNKYADSVKGRFTISRDTSKNTLYLQMNSLRVEDTAVYYCARADSSGYYKGSEYFQH WGQGTLVTVSS | ADI-36676 | Heavy chain variable region ("HC") amino acid sequence |
| Ab 832 | 1664 | SYELTQLPSVSVAPGQTARITCGGNNIGTKSVQWYQHKPGQAPVLVVYDDSDRPS DIPERFSGSNSGNTATLTISRVEAGDEADYYCQVWDSSSDHYVFGTGTKLTVL | ADI-36676 | Light chain variable region ("LC") amino acid sequence |
| Ab 833 | 1665 | EVQLVQSGGGLVQPGGSLRLSCAASGLTVSTNYMSWVRQLPGKGLEWVSVIYSG GNTYADSVKGRFTISRDNSKNIVLEMNSLRIEDTAVYYCARAHLNNWFVSVTDT KDYYFDYWGQGTLVTVSS | ADI-36678 | Heavy chain variable region ("HC") amino acid sequence |
| Ab 833 | 1666 | SYELTQPPSVSVLPGQTASITCSGDKLGDKYASWYQQKPGQSPILVVFQDDKRPSGI PERFSGSNSGNTATLTISGTQATDEADYYCQACDRNTGVFGTGTKLTVL | ADI-36678 | Light chain variable region ("LC") amino acid sequence |
| Ab 834 | 1667 | EVQLVESGGGLVQPGGSLRLSCAASGFTFSPYSMNWVRQAPGKGLEWVSISRSG SFKYYADSVKGRFTISRDDAKNSLYLHMNSLRDDDTAVYYCVSYCSSATCHQRFDY WGQGTLVTVSS | ADI-41552 | Heavy chain variable region ("HC") amino acid sequence |
| Ab 834 | 1668 | EIVLTQSPATLSLSPGERATLSCRASQSVNSYLAWYQQKPGQAPRLLIYDASNRATGI PARFSGSGSGTDFTLTISSLEPEDFAVYYCQERNSWPKLITFGGGTKVEIK | ADI-41552 | Light chain variable region ("LC") amino acid sequence |
| Ab 835 | 1669 | EVQLVESETEVKKPGASVKVSCKASGYTFTKYGISWVRQAPGQGLEWMGWISAYN GNTMYPHKLLGRVTMTDTSTSTAYMELRSLRSDDTAVYYCARDQTYYDFWSGYY TYWGQGTLVTVSS | ADI-41553 | Heavy chain variable region ("HC") amino acid sequence |
| Ab 835 | 1670 | DIVMTQTPSTLSASVGDRVTITCRASQSISSWLAWYQQKPGKAPKLLIYKASSLESG FTLTISSLQPDDSATYYCQQYNSYSRTFGQGTKVEIK | ADI-41553 | Light chain variable region ("LC") amino acid sequence |
| Ab 836 | 1671 | EVQLVESGGGLVQPGGSLRLSCAASGFTFSSYPMNWVRQPGCKGLEWVSSISSSG ASPYYADSVKGRFTISRDNSKNTLYLQMNSLRADDTAVYYCAREDYYYYMDVWG KGTTVTVSS | ADI-41554 | Heavy chain variable region ("HC") amino acid sequence |
| Ab 836 | 1672 | ETTLTQSPSTLSASVGDRVTITCRASESISSWLAWYQQKPGKAPKLLIFKASTVQSGV PSRFSGSGSGTEFTLTISSLQPDDFATYYCQQYNSYLLTFGGGTKVEIK | ADI-41554 | Light chain variable region ("LC") amino acid sequence |
| Ab 837 | 1673 | EVQLVESGPGLVKPSQTLSLTCSVSGGSISSGIHYWSWIRQHPGKGLEWICYIYYSGS TYYNPSLESRITISVDTSKNQFSLKVSSVTAADTAVYYCARVNRASRMTTFGVANERS IYYFMDVWGKGTTVTVSS | ADI-41555 | Heavy chain variable region ("HC") amino acid sequence |
| Ab 837 | 1674 | ETTLTQSPATLSLSPGERATLSCRATQSVGNYLAWYQQKPGQAPRLLIHDASNRAT GIPARFSGSGSGTDFTLTISSLEPEDFAVYYCQLRINWLFTFGPGTKVEIK | ADI-41555 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 838 | 1675 | EVQLLESGGGLVKPGGSLRLSCAASGFSFSSYSMHWVRQAPGKGLEWVSSISSSSTYIYYADSVKGRFTISRDNAKTSLFLQMNSLRAEDTAVYYCARDPYSSGWYNDWGQGTTVTVSS | ADI-41556 | Heavy chain variable region ("HC") amino acid sequence |
| Ab 838 | 1676 | EIVMTQSPATLSVSPGERATLSCRASQSVSGNLAWYQQKPGQAPRLLIYGASTRATGIPARFSGSGSGTEFTLTISSLQSEDFAVYYCHQYNNRPATFGQGTKVDIK | ADI-41556 | Light chain variable region ("LC") amino acid sequence |
| Ab 839 | 1677 | EVQLLESGPGLVKPSETLSLTCNVSGGSISSYYWSWIRQSPGKGLEWIGHIYDTGYTNYNPSLKSRVTMSVDTSKNRFSLKLDSVTAADTAVYYCARGRGWRNLYNWFDPWGQGTLVTVSS | ADI-41557 | Heavy chain variable region ("HC") amino acid sequence |
| Ab 839 | 1678 | DIVMTQSPATLSVSPGERATLSCRTSQSFSSMLAWTQQKPGQAPRLLIYGASTRATGIPARFSGSGSGATEFTLTISNLQSEDVAVYYCQQYNSWPLTFGGGTKVEIK | ADI-41557 | Light chain variable region ("LC") amino acid sequence |
| Ab 840 | 1679 | EVQLLESGGGLVKPGGSLRLSCEVSGFPFSDYYVSWIRQAPGKGLEWLSYSSRGGIYTNYADSVKGRFTISRDNDKNSLFLQMNSLRAEDTAVYYCARDRSDIWSGRVGFDYWGQGTLVTVSS | ADI-41558 | Heavy chain variable region ("HC") amino acid sequence |
| Ab 840 | 1680 | DIVMTQSPATLSLSPGERATLSCRASQSVSSSYLAWYQQKPGQAPRLLIYGASSRATGIPDRFSGSGSGTDFTLTISRLEPEDFAVYYCQQYNKSPPGYIFGPGTKVDIK | ADI-41558 | Light chain variable region ("LC") amino acid sequence |
| Ab 841 | 1681 | QVQLVQSGPTLVKPTQTLTLTCSFSGFSLNTGVGWIRQPPGKALEWLALIYWDDDKRYRPSLKSRLTITKDTSKSQVVLTMTNMDPLDTATYYCAHRRSAYDPIYFDYWGQGALVTVSS | ADI-41561 | Heavy chain variable region ("HC") amino acid sequence |
| Ab 841 | 1682 | DIRVTQSPSSVSASVGDRVTITCRASRSINNWLAWYQQKPGKAPKLLIYAASSLQSGVPSRFSGSGYGTDFTLTISSLQPEDFATYYCQQAHSFPSITFGQGTRLEIK | ADI-41561 | Light chain variable region ("LC") amino acid sequence |
| Ab 842 | 1683 | QVQLVQSGAEVKKPGASVRVSCKTSGYAFSKYGISWVRQAPGQGLEWIGWISAYNENTHFSHKFLGRVTMTDTSTGIAYMDLRSLKSDDTAVYYCARDWYSLGSDWYFGPMFDYWGQGTLVTVSS | ADI-41562 | Heavy chain variable region ("HC") amino acid sequence |
| Ab 842 | 1684 | EIVLTQSPDTLSVSPGERATLSCRASQSVTTNLAWYQQKPGHAPRLLIYGASTRATGIPARFSGSGSGTEFTLTISSLQSEDFAIYYCQQYTNWPRTFGQGTKVEIK | ADI-41562 | Light chain variable region ("LC") amino acid sequence |
| Ab 843 | 1685 | QVQLVESGPGLVKPSETLSLTCTVSDDSITNNFWTWIRQPPGKGLEWIGIYIYYSGSTNYNPSLKSRITMSVDLSKNQFSLKLSSVTAADTAVYYCARLITSGGVDYWGQGTLVTVSS | ADI-41563 | Heavy chain variable region ("HC") amino acid sequence |
| Ab 843 | 1686 | QSVLTQPPSLSGAPGQRVTISCTGSSSNIGADYHVHWYQQLPGTAPKLLIYQNTNRPSGVPDRFSASKSGTSVSLAITGLQAEDEADYYCQSYDSSLSAWVFGGGTKLTVL | ADI-41563 | Light chain variable region ("LC") amino acid sequence |
| Ab 844 | 1687 | QVQLVQSGAEVKKPGSSVKVSCKAFGGTLRRYALSWVRQAPGQGLEWMGGIIPVFGTRRYAQKFQGRITITADGSTSTASMEVSSLRFEDTAIYYCATVVFDFVSGPPPTYYYYMDVWGKGTTVTVSS | ADI-41564 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 844 | 1688 | DIVMTQSPGTLSLSPGERATLSCRASQSVSSSYLAWYQQKPGQAPRLLIYGASSRAT GIPDRFSGSGSGTDFTLTISRLEPEDFAVYYCQQYDSSLRVLTFGGGTKVDIK | ADI-41564 | Light chain variable region ("LC") amino acid sequence |
| Ab 845 | 1689 | QVQLQQWGAGLLKPSETLSLTCEVYGGSFSGYYWTWFRQPPGEGLEWIGEINHSG GTNYNPSLKSRVTMSVDASINQFSLQLSSVTAADTSVYYCARGHYNTNDPYGLFD YWGQGTLVTVSS | ADI-41567 | Heavy chain variable region ("HC") amino acid sequence |
| Ab 845 | 1690 | DIRLTQSPSFLSASVGDRVTITCRASQGISTYLAWYQQKPGKAPKLLIYAASTLHSGV PSRFSGSGSGTEFTLTISSLQPEDFATYYCQQLNRYPPSTFGPGTKLEIK | ADI-41567 | Light chain variable region ("LC") amino acid sequence |
| Ab 846 | 1691 | QVQLQQWGARLLKPSETLSLTCAVYGGSFSGYYWSWIRQSPCKGLEWIGEINHSG STNYNPSLKSRVTISRDTSKKQFSLKVSSVTAADTAVYYCARDPPIRCNGDSCKSDQY RYGMDVWGQGTTVTVSS | ADI-41568 | Heavy chain variable region ("HC") amino acid sequence |
| Ab 846 | 1692 | QPGLTQPPSVSVSPGQTARITCSGDALPKQYAYWYQQKPGQAPVLVIHKDNERPS GIPERFSGSSGSGTTVLTISGVQAEDEADYYCQSADTSGSYRLFGGGTKLTVL | ADI-41568 | Light chain variable region ("LC") amino acid sequence |
| Ab 847 | 1693 | EVQLLESGAEVKKPGSSVKVSCKASGFTFSTYAISNVRQAPGQGLEWMGGIIPVLG TTKYAQKFQDRVTITADESTSTAYMDLSGLRSDDTAVYYCARGVWGDCGRASCLF DWYFDLWGRGTLVTVSS | ADI-41569 | Heavy chain variable region ("HC") amino acid sequence |
| Ab 847 | 1694 | EIVMTQSPATLSVSPGERVTLSCSASQTVSSNLAWYQKPGQAPRLLIYGASIRATDI PARFSGSGSRTEFTLTISSLQSEDFAVYYCQQYNNRPPLTFGGGTKVEIK | ADI-41569 | Light chain variable region ("LC") amino acid sequence |
| Ab 848 | 1695 | QVQLVQSGAEVKKPGSSVKVSCMASGFTFSNSAINWVRQAPGQGLEWMGGTIPI FGAANYAQRFQARVTITADKSTSTAYMELTSLRSDDTAVYYCVRTPHRSSDHIWGS YRYFDSWGQGTLVTVSS | ADI-41570 | Heavy chain variable region ("HC") amino acid sequence |
| Ab 848 | 1696 | QSVVTQEPSVSAAPGQKITISCSGGSTSNIGINYVSWYQQFPGTAPKLLIYDNDKRPSG IPDRFSGSKSGTSATLGITGLQAGDEADYYCGTWDSSLSAGHIFGGGTKVTVL | ADI-41570 | Light chain variable region ("LC") amino acid sequence |
| Ab 849 | 1697 | EVQLLESGGGLVKPGGSLRLSCEASGFPFNSYHMNWIRQSPCKGLEWVSYITGGSS FSNYADSVKGRFTISRDNAKNSLYLQMNSLRAEDTAVYYCARTTLDCTSTSCHYRFD YWGQGTLVTVSS | ADI-41571 | Heavy chain variable region ("HC") amino acid sequence |
| Ab 849 | 1698 | QSVLTQPPSVSGAPGQRITISCNGSNSNIGAGYDVHWYQQLPGKAPKLLIYSNNNR PSGVPDRFSGSKSGTSASLAITGLQGEDEADYYCQSHDTRLSGNVVFGGGTKLTVL | ADI-41571 | Light chain variable region ("LC") amino acid sequence |
| Ab 850 | 1699 | QITLKESGPTLVKPTQTLTLTCTFSGFSLSTSGVGVAWIRQPPGKALEWLALIYWDD DKRYSPSLKSRLTITKDTSKNQVVLTMTNMDPVDTATYYCAHSSVTTPFDYWGQ GSLVTVSS | ADI-41574 | Heavy chain variable region ("HC") amino acid sequence |
| Ab 850 | 1700 | DIQLTQSPSTLSASVGDRVTITCRASQSISDMLAWYQQKPGKAPKLLIYKAFTLESGV PSRFSGSGSGTEFTLTISSLQPDDFATYYCQQYTSWTFGQQTKVEIK | ADI-41574 | Light chain variable region ("LC") amino acid sequence |
| Ab 851 | 1701 | QVTLKESGPTLVKPTQTLTLSCSFSGFSLSAYAVGVGWIRQPPGKALEWLALIYWDD DKRYSPSLETRLTITKDTSKNQVVLTMTKMDPVDTATYYCVYSYNGYEYMDVWG NGTTVTVSS | ADI-41576 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 851 | 1702 | DIVMTQSPATLSLSPGERATLSCRASQSVSNYLAWYQQKPGQAPRLLISGASNRAT GIPDRFSGSGSGTDFTLTITTPEPEDFAVYYCQQRNAWPRTFGQGTKVEIK | ADI-41576 | Light chain variable region ("LC") amino acid sequence |
| Ab 852 | 1703 | EVQLVESGGGVVQPGRSLRLSCAASGFTLSSYVMDWVRQAPGKGLEWVAVISYD GSSKYYADSVKGRFTVSRDNSNNAMYLQMNSLRAEDTAVYYCARDPYYDILTGYSY FDYWGHGTTVTVSS | ADI-41578 | Heavy chain variable region ("HC") amino acid sequence |
| Ab 852 | 1704 | SYVLTQPPSVSGAPRQTATITCGGNNIGSKSVNWYQQKPGQAPVLVVYDDSARPS GIPERFSGSNSGNTATLTVSSVEAGDEADYFCQVWDTSSAPYPWVFGGGTKLTVL | ADI-41578 | Light chain variable region ("LC") amino acid sequence |
| Ab 853 | 1705 | QVQLVESGAEARKPGSSVKVSCKLLSGGTFSTDPISWVRQAPGQGLEWMGRIIPLLG IANYAQKFQGRVTIIADKSTSTVYMELRNLRFEDTAVYFCARRGDGYYGMDVWGQ GTTVTVSS | ADI-41579 | Heavy chain variable region ("HC") amino acid sequence |
| Ab 853 | 1706 | QSVLTQPASVSGSPGQSITISCTGTSNDIGGYDYVSWYQQHPGKAPKLMIYDVHNR PSGVSNRFSGSKSGNTASLTISGLQAEDEADYYCSSFSDSGNLYVFGTGTKLTVL | ADI-41579 | Light chain variable region ("LC") amino acid sequence |
| Ab 854 | 1707 | QVQLQQWGAGLLKPSETLSLTCAVYGGSFSGYYWSWIRQPPGKGLEWIGEMNHS GGSNYNPSFKSRVTISVDTSKKYFSLNLSSVTAADTAIYYCARTPFYYESTGYYYYYG MDVWGQGTTVTVSS | ADI-41580 | Heavy chain variable region ("HC") amino acid sequence |
| Ab 854 | 1708 | DIVMTQTPDSLAVSLGERATINCKSSQSVSHSSNNKNYLSWYQQKPGQPPKLLIYW ASIRESEAPDRFTGSGSGTDFTLTISSLQAEDVAVYYCQQYYTAPITFGQGTRLEIK | ADI-41580 | Light chain variable region ("LC") amino acid sequence |
| Ab 855 | 1709 | EVQLLESGSELKKPGASVKISCKTSGYTFTNYLMMWVRQAPGQGLEWMGWINTH TGNPTYAQDFTGRFVFSLDTSVNTAYLQISSLKAEDTAIYYCARDGLEAFSGYNGVD YWGQGTLVTVSS | ADI-41581 | Heavy chain variable region ("HC") amino acid sequence |
| Ab 855 | 1710 | DIVMTQTPLSLPVTPGEPASISCRSSPSLLHSNGYNYLDWYLQKPGQSPQLLIYLGST RASGVPDRFSGSGSGTDFTLRISRVEAEDVGVYYCMQALQIPLTFGQGTKLEIK | ADI-41581 | Light chain variable region ("LC") amino acid sequence |
| Ab 856 | 1711 | EVQLVESGPGLVKPSQTLSLTCTVSGGPISSGVYYWSWIRQHPGKGLESIGYIYYSGS THYNPSLKTRVTISLDTSKNQPSLKLSSVTAADTAVYYCARGCCSGGSCYLYAFDIWG QGTTVTVSS | ADI-41582 | Heavy chain variable region ("HC") amino acid sequence |
| Ab 856 | 1712 | QPVLTQPPSVSVAPGQTARITCGGNNIGTKSVHWYQQKPGQAPLLVVYDDSDRPS GIPERFSGSGSNTATLTISRVEAGDEADFYCQVWDYATDHVVFGGGTKLITVL | ADI-41582 | Light chain variable region ("LC") amino acid sequence |
| Ab 857 | 1713 | QVQLVQSGAEVKKPGSSVKVSCKASGGTFSRHTITWVRQAPGQGLEWMGRIAPIV GFANYAQKFQGRVTITADKSTSTAYMELRSEDTAVYYCARRSEDYYGLDVWG QGTTVTVSS | ADI-41583 | Heavy chain variable region ("HC") amino acid sequence |
| Ab 857 | 1714 | DIVMTQSPSSLSASVGDRVTITCQASQDISNYLNWYQQKPGKAPKLLIYEASNLETG VPSRFSGSGSGTDFTFTISSLQPEDIATYYCQQYDNLFGGGTKLEIK | ADI-41583 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 858 | 1715 | QVQLVESGAEVKKPGASVKVSCKASGYTFTDYYIHWVRQAPGQGLEWVGRINPNS GYINYAQKFQGRLTMTRDTSISTAYLELSSLRSDDTAVYYCTRLPLLEPLNFFDYWGQ GTLVTVSS | ADI-41584 | Heavy chain variable region ("HC") amino acid sequence |
| Ab 858 | 1716 | QSVVTQPPSVSGAPGQRVTISCTGSSSNIGAGYDVHWYQQLPGTAPKVLIYGNNNN RPSGVPDRFSGSKSGTSASLAITGLQAEDEADYYCQSFDSLSSSVFGTGTKLTVL | ADI-41584 | Light chain variable region ("LC") amino acid sequence |
| Ab 859 | 1717 | EVQLLESGGGLVKPGGSLRLSCAASGFTFADYYMSWIRQAPGKGLEWVSYISGGSS FTNYADSVKGRPTISRDNAKNSLYLQMNSLRADDTAVYYCARGISPALGGGEYFQD WGQGTLVTVSS | ADI-41585 | Heavy chain variable region ("HC") amino acid sequence |
| Ab 859 | 1718 | QPVLTQPPSVSGAPGQRVTISCTGSSSNIGAGYDVHWYQHLPGTAPKLLIYGNSNR PSGVPDRFSGSKSTSASLAITGLQAEDEADYYCQSYDSSLGGYVFGTGTKVTVL | ADI-41585 | Light chain variable region ("LC") amino acid sequence |
| Ab 860 | 1719 | QVQLQQWGAGLLKPSETLSLTCAVYGGSFSGYSWSWIRQPPCKGLEWIGDIDHD GSTYNSSLKSRVIMSIDTSKNQFSLKLSSVTAADTAVYYCARVGGNSGYWGQGTL VTVSS | ADI-41586 | Heavy chain variable region ("HC") amino acid sequence |
| Ab 860 | 1720 | DIVMTQTPLSLPVTPGEPASISCRSSQSLLHSNGFNVLDWYLQKPGQSPQLLIYLGSN RASGVPDRFSGSGSGTDFTLKISRVEAEDVGVYYCMQALQTLTFGPGTKVEIK | ADI-41586 | Light chain variable region ("LC") amino acid sequence |
| Ab 861 | 1721 | QVQLVQSGAGLLKPSETLSLTCAVYGGSFSGYSWSWIRQPPGKGLEWIGEINYSVS TSYNSSLKSRVSISVDTSKNQFSLKLTSVTAADTAVYYCARVGGAVADWGQGTLVT VSS | ADI-41587 | Heavy chain variable region ("HC") amino acid sequence |
| Ab 861 | 1722 | EIVLTQSPLSLPVTPGEPASISCRSSQRLLHSNGYTNYLDWYLDWYLQKPGQSPQLLIYLGSN RASGVPDRFSGSGSGTDFTLKISRVEAEDVGVYYCMQNLQTLTFGGGTKVDIK | ADI-41587 | Light chain variable region ("LC") amino acid sequence |
| Ab 862 | 1723 | QVQLVESGPTLVKPTQTLTLTCTFSGFSLSTNGVGVAWIRQPPGKALEWLAIIYWD DDKRYSPSLKSRLTIITKDTSKNQVLITVTDMDPVDTATYYCAHTIGVPAATRFDYW GQGTLVTVSS | ADI-41588 | Heavy chain variable region ("HC") amino acid sequence |
| Ab 862 | 1724 | SYELTQPPSVSVSPGQTASITCSGDKLGDKFACWYQQKPGQSPVLVIYQDNKRPSGI PERFSGSGSNSGNTATLTISGTQAMDEADYYCQAWDSSTASYVFGTGTKLTVL | ADI-41588 | Light chain variable region ("LC") amino acid sequence |
| Ab 863 | 1725 | EVQLLESGGGLVQPGGSLRLSCAASGFTFNFFALTNVRQAPCKGLEWVSAISGSGE STYYADSVKGRPTISRDNSKNTLYLQMNSLRAEDTAVYYCAKFARSGDYASFFDYW GQGTLVTVSS | ADI-41589 | Heavy chain variable region ("HC") amino acid sequence |
| Ab 863 | 1726 | DIRVTQSPDSLAVSLGERATINCKSSQNVFYSSNNKNFLAWYQQKPGQPPKLLIYW ASTRESGIPDRFSGSGSGTDFTLTISSLQAEDVAVYYCQQYYSTKFTFGPGTKVEIK | ADI-41589 | Light chain variable region ("LC") amino acid sequence |
| Ab 864 | 1727 | EVQLVQSGGGLVKPGGSLRLSCAASGFTISDHYMSWIRQAPGKGLEWISYISSTSSF TNYANSVKGRFTISRDNAKNSLYLQMNSLRAEDTAVYYCARDRSILYSGYSLDYWG QGTLVTVSS | ADI-41590 | Heavy chain variable region ("HC") amino acid sequence |
| Ab 864 | 1728 | DIQMTQSPSSLSASVGDRVTISCRASQSIINYLNWYQHKPGKAPKLLIYAASSLQSG VPSRFSGSGSGTDFTLTISGLQPEDFATYYCQQSDSTRTFGGGTKVEIK | ADI-41590 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 865 | 1729 | QVTLKESGGGLVKPGGSLRLSCAASGFTFSDYYMSWIRQAPGKGLEWVSYISSSSSY TNYADSVKGRFTISRDNAKNSLYLQMNSLRAEDTAVYYCAREAVAAGTDYFDYW GQGTLVTVSS | ADI-41591 | Heavy chain variable region ("HC") amino acid sequence |
| Ab 865 | 1730 | QSVLTQPPSVSGAPGQRVTISCTGSSSNIGAGYDVHWYQQPPRTAPKLLIYGNSNR PSGVPDRFSGSKSGTSASLAITGLQAEDEADYYCQSYDSSLSGYVFGTGTKLTVL | ADI-41591 | Light chain variable region ("LC") amino acid sequence |
| Ab 866 | 1731 | EVQLVESGSELKKPGASVKVSCKASGYTFRTYVMNWVRQAPGQGLEWMGWINT NTGNPTYAQGFTGRFVFSLDTSVSTAYLQISLKAEDTAVYYCARESIDDYDSSGYGR TFDYWGQGTLVTVSS | ADI-41592 | Heavy chain variable region ("HC") amino acid sequence |
| Ab 866 | 1732 | SYELTQPPSVSVSPGQTASIPCSGDKVGKTYVYWYQQTPGQSPGLVIYQDTKRPSGI PERFSGSSSGNTATLTISGTQTMDEADYYCQAWDTSTASYVFGTGTKLTVL | ADI-41592 | Light chain variable region ("LC") amino acid sequence |
| Ab 867 | 1733 | QVQLVQSGVEVKKPGESLRLISCKGSGYSFTNYWIAWVRQMPGKGLEWMGIIYPG DSDTRYSPSFQQGVTISADKSISTAYVQWSSLKASDTAIYYCARGDILTNSGPDAFDI WGQGTMVTVSS | ADI-41593 | Heavy chain variable region ("HC") amino acid sequence |
| Ab 867 | 1734 | DIQMTQSPSSFSASTGDRVTITCRASQAISSYLAWFQQKPGKAPKLLIYAASTLQSG VPSRFSGSGSGTDFTLTISCLQSEDFATYYCQQYYSSYPLTFGGGTKVEIK | ADI-41593 | Light chain variable region ("LC") amino acid sequence |
| Ab 868 | 1735 | EVQLVESGGGLVKPGGSLRLSCAASGFTFSSYYMNWVRQAPGKGLEWVSSISPSSS YTNYADSVKGRFTISRDNAKDSLYLQMNSLRAEDTAVYYCARDGLLGITIFGVVQDY WGQGTLVTVSS | ADI-41594 | Heavy chain variable region ("HC") amino acid sequence |
| Ab 868 | 1736 | QSVVTQPPSVSGAPGQRVTISCTGSSSNIGAGYDVHWYQQLPGTAPKLLIYGNTNR PSGVPDRFSASKSGTSASLAITGLQAEDEADYYCQSYDSSLSVVFGGGTKLTVL | ADI-41594 | Light chain variable region ("LC") amino acid sequence |
| Ab 869 | 1737 | QVQLVQSGGGVVQPGGSLRLSCAASGFTFSDYGMHWVRQAPGKGLEWVAVISD GGSNQYSADSVRGRFTISRDNSKNTLYLQMNSLRPEDTAVYYCAKARIAARAIFDY WGQGTLVTVSS | ADI-41595 | Heavy chain variable region ("HC") amino acid sequence |
| Ab 869 | 1738 | DIQLTQSPSSLSASVGERITITCQASRDVRIYLNWYQHKPGKAPKLLIYDASNLETGV PSRYSGSGSGTDFTFTISSLQPEDIATYFCQQYDLLPPTFGVGTKVEIK | ADI-41595 | Light chain variable region ("LC") amino acid sequence |
| Ab 870 | 1739 | QVQLQQWGAGLLKPSETLSLTCAVYGDSFSGYFWTWIRQPPGKGLEWIGEINLSG STNYNPSLKSRVTILVDTSKNQFSLKLSSVTAADTAVYYCARGLHVSDDQDSSGYYF HPGSFDYWGQGTLVTVSS | ADI-41596 | Heavy chain variable region ("HC") amino acid sequence |
| Ab 870 | 1740 | DIRMTQSPDSLAVSLGERATINCKSSQSVLYSSNNKNYLAWYQQKPGQPPKLLINW ASTRESGVPDRFSGSGSGTDFTLAISSLQAEDVAVYYCQQYYSTPLTFGGGTKVEIK | ADI-41596 | Light chain variable region ("LC") amino acid sequence |
| Ab 871 | 1741 | QVQLQESGPGLVKPSETLSLTCTVSGASVSSNNYNWSWIRQPPGKGLEWIGYIYYS GSTNYNASLKSRVTISVDTSKNQFSLKLSSVTAADTALYYCAGEHFGVASPPEAPFD YWGQGTMVTVSS | ADI-41597 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 871 | 1742 | SSELSQPPSVSVAPGKTARITCGGNNIGIKSVHWYQQKPGQAPVLVIYSDSRPSGI PERFSGSGNSGNTATLTITRVEAGDEADYYCQVWDSSSDHFVFGIGTKVTVL | ADI-41597 | Light chain variable region ("LC") amino acid sequence |
| Ab 872 | 1743 | EVQLVESGPGLVKPSETLSLTCTVSGGSITPYYWSWIRQPPGKGLEWIGNISYSGSTT YNPSLKSRVTISVDRSKDQFSLRLRSVTAADTAVYYCARVVTLVLGVSLNDAFDIWG QGTMVTVSS | ADI-41598 | Heavy chain variable region ("HC") amino acid sequence |
| Ab 872 | 1744 | DIQMTQSPSSLSASVGDRVTITCRASQSISRYLNWYQHKPGKAPILLIYAATTLESGV PPRFSGSGSGTDFSLTISSLQPEDFATYYCQQSYSVPLITFGGGTKLEIK | ADI-41598 | Light chain variable region ("LC") amino acid sequence |
| Ab 873 | 1745 | EVQLLESGGGLVQPGGSLRLSCAASGFIFSNYEMNWVRQAPGKGLEWISHIITPTGN SIYYADSVKGRFTISRDNAKNAQYLQMHSLRPDDTAIYYCARGEDPIAATGGFDSW GQGTLVTVSS | ADI-41599 | Heavy chain variable region ("HC") amino acid sequence |
| Ab 873 | 1746 | EIVLTQSPSSLSASVGDRVTIPRRSSQNVDKFLHWYQQRPGKAPKLLIYAAFSLQSGV PSRFSGSGSGTDFTLTISSLQPEDFATYYCQQSYSTPFTFGQGTKVEIK | ADI-41599 | Light chain variable region ("LC") amino acid sequence |
| Ab 874 | 1747 | EVQLLESGGNMVQPGKSLRLSCAASGFTFSNYGMHWVRQAPGKGLEWVAVISKD GNNEHYADSVRARFTVSRDNSKNTLFLQMNSLRPEDTAVYYCAIGGLSGSVFPGEYF QHWGRGTLVTVSS | ADI-41600 | Heavy chain variable region ("HC") amino acid sequence |
| Ab 874 | 1748 | DIQMTQSPSSMSASLGDRVTITCRASQGISTWLAWYQQKPGEAPKLLIYAAFGLQS GVPSRFSGSGSGTDFLTINNLQPEDFATYYCQQALSFPFTFGGGTKVEIK | ADI-41600 | Light chain variable region ("LC") amino acid sequence |
| Ab 875 | 1749 | EVQLLESGGGLVKPGGSLRLSCAGSGFRFSDYYMTWIRQAPGKGLEWVSYISSSSTY TYTDSVKGRFTVSRDNAKNSLYLQMNTLRAEDTAIYYCAISNRYDSRTFYDYWG QGTLVTVSS | ADI-41601 | Heavy chain variable region ("HC") amino acid sequence |
| Ab 875 | 1750 | QSVLTQPPSVSGAPGQRVIISCTGSSNIGAGYDVHWYQQFPGTAPKLLIYGNNNR PSGVPERFSGSKSGTSASLAITGLQADDEADYYCQSYDSLSEVVFGGGTKVTVL | ADI-41601 | Light chain variable region ("LC") amino acid sequence |
| Ab 876 | 1751 | EVQLQESGPGLVKPSETLSLTCTVSGGSLSGYYWSWIRQPPCKGLEWIGYIYHSGST NYNPSLESRVTISVDTSKNQFSLKVNAVTAADTAVYYCAKVERLLRFDPWGQGTLV TVSS | ADI-41602 | Heavy chain variable region ("HC") amino acid sequence |
| Ab 876 | 1752 | QSVLIQPASVSGSPGQSITISCIGSSSDVGGYNYVSWYQHYPGKAPKLMIYDVSNRP SGVSNRFSGSKSGNTASLTISGLQAEDEADYYCCSSYTSSYSVFGTGTKVTVL | ADI-41602 | Light chain variable region ("LC") amino acid sequence |
| Ab 877 | 1753 | EVQLVESGGGLVKPGRSLRLSCTTSGFTEGDYAMSWFRQAPGKGLEWVGFIRSKPY GGATAYAASVRGRFTISNDDSKSIAYLQMESLKIEDTAVYYCARDYDDFFFYDYWG QGTLVTVSS | ADI-41603 | Heavy chain variable region ("HC") amino acid sequence |
| Ab 877 | 1754 | DIRMTQSPATLSVSPGERATLSCRASENIYSNLAWYQQKPGQAPRLLIYGASTRATG LPARFSGSGSGTEFTLTISSLQSEDFAVYYCQQYNMWPAFGGGTKVEIK | ADI-41603 | Light chain variable region ("LC") amino acid sequence |
| Ab 878 | 1755 | QVTLKESGAEVKKPGASVKVSCKASGYTFTGYYMHWVRQAPGQGLEWMGRINP NSGGTNYAQKFQGRVTMTRDTISTAYMELSRLRSDDTAVYYCAREASRFGGFDY WGQGTLVTVSS | ADI-41604 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 878 | 1756 | DIVLTQSPSSLSASVGDRVTITCQASQDISNYLNWYQQKPGKAPKLLIYDASNLETG VPSRFSGSGSGTDFTFTISSLQPEDIATYYCQQYDNLLGYTFGQGTKVEIK | ADI-41604 | Light chain variable region ("LC") amino acid sequence |
| Ab 879 | 1757 | QVQLVESGPGLVKPSQTLSLTCSVSGGSISSDDHYMSWIRQHPGKGLEWIGYIYYS GYTNYNPSLKSRVTISVDTSKNQFSLRLSSVTAADTAVYYCARETDITIFGVPVGYF DYWGQGTLVTVSS | ADI-41605 | Heavy chain variable region ("HC") amino acid sequence |
| Ab 879 | 1758 | DIQVTQSPDSLAVSLGERATINCKSQSILSSTNNKNFLAWYQQKPGQPPKLLHW ASTREFGVPDRFSGSGSGTEFLTISLQAEDVAVYYCQQYYTTPYTFGQGTKVEIK | ADI-41605 | Light chain variable region ("LC") amino acid sequence |
| Ab 880 | 1759 | EVQLLESGPGLVKPSETLSLTCTVSGGSVSSGGYYYTWIRQPPGKGLEWIGYAFYSG DTNYNPSLKSRVTISVDTSKNQFSLKLTSVTAADTAVYYCASTYTFGASGPFDFWGQG TLVTVSS | ADI-41606 | Heavy chain variable region ("HC") amino acid sequence |
| Ab 880 | 1760 | DIVMTQSPSFMSASVGDRVTITCRASQGISNWLLNWYQQKPGKAPKLLIYAASSLQS GVPSRFSGSRSGTDFTLTISSLQPEDFAIYYCQQANSFPLTFGQGTRLEIK | ADI-41606 | Light chain variable region ("LC") amino acid sequence |
| Ab 881 | 1761 | EVQLVESGPGLVKPSQTLSLTCTVSGGSINIGGYYMSWIRQHPEKGLEWIGYIYYSG TTYYNPSLESRVTISIDTSKNQFSLNLSSVTAADTAVYYCASVDQIGATRPDYWGQG TLVTVSS | ADI-41607 | Heavy chain variable region ("HC") amino acid sequence |
| Ab 881 | 1762 | QPVLTQPRSVSGSPGQSVTLSCTGTSSDVGTYNYVSWYQHHPGKAPKLLIYDVNKR PSGVPDRFSGSKSGNTASLTISGLQAEDEADYYCCSYAGSYTLNVVFGTGTKLTVL | ADI-41607 | Light chain variable region ("LC") amino acid sequence |
| Ab 882 | 1763 | QVQLVQSGDEVKKPGESLKISCKGSEHTFTNYWIAWVRQMPGKGLECMGVIWPD DSDTKYSPSFQGQVTISADKSINTAYLHLSSLRASDTAMYYCATSKFRTGFDFWGQG TLVTVSS | ADI-41608 | Heavy chain variable region ("HC") amino acid sequence |
| Ab 882 | 1764 | NFMLTQPHSVSESPGKTVIISCTRSSGNIASNYVQWYQQRPGSSPTTVVYEDNQRP SGVPDRFSGSIDSSSNSASLTISGLKTEDEADYYCQSYDSSNPWVFGGGTKLTVL | ADI-41608 | Light chain variable region ("LC") amino acid sequence |
| Ab 883 | 1765 | QVQLVESGAEVKKPGASVKVSCKASGYSFTSYYMHWVRQAPGQGLEWMGVISTN GGTASYSQNFRGRVILTRDTSTSTAYMELSSLTSEDTAVYYCVREGYCNGGSCSYFD SWGQGTLVTVSS | ADI-41609 | Heavy chain variable region ("HC") amino acid sequence |
| Ab 883 | 1766 | QSVLTQPPSVSGAPGQRVSISCTGSSSNIGAGYDVHWYQQLPGTAPKVLIYGNNYR PSGVPDRFSGSKSGTSASLAITGLQTEDEADYYCQSYDSRLSVVFGGGTKLTVL | ADI-41609 | Light chain variable region ("LC") amino acid sequence |
| Ab 884 | 1767 | EVQLLESGGGVVQPGRSLRLSCAASELSFRNYGMHWVRQAPGKGLEWVAVLSYD GNDKYADSVKGRFTISRDNSKKTLYLQMDSLRAEDTAVYYCAKRGAYCGGDCFSS WGQGTLVTVSS | ADI-41610 | Heavy chain variable region ("HC") amino acid sequence |
| Ab 884 | 1768 | GIQLTQSPSSLSASVGDRVTITCRASQSSSYLNWYQQKPGKAPKLLIYAASSLQSGV PSRFSGSGSGTDFTLTISSLQPEDFATYYCQQSYSFGGGTKVEIK | ADI-41610 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 885 | 1769 | EVQLVESGGGLVKPGGSLRLSCAASGFTFSDYSMNWVRQAPGKGLEWVSSTSSGS TYIYYADSVKGRFTISRDNGKNSLYLQMNSLRAEDTAVYYCARAFRLGYDALDIWG QGTMVTVSS | ADI-41611 | Heavy chain variable region ("HC") amino acid sequence |
| Ab 885 | 1770 | DIRMTQSPSSLSASVGDRVTIICRASQSISNYLNWYQQKPGKAPKLLIYASNLQSG VPSRFSGSGSGTDFTLTISSLQPEDFATYYCQQTYSPPPTFGGGTKLEIK | ADI-41611 | Light chain variable region ("LC") amino acid sequence |
| Ab 886 | 1771 | EVQLQESGPGLVKPSGTLSLTCAVAGGFISSGNWWSWIRQPPGKGLEWIGEVYHS GRTSYNPSLKSRVTISVDNSKNQFSLKMSSVTAADTAVYYCARVESYSSSGYYIAYD NWGQGNLVTVSS | ADI-41626 | Heavy chain variable region ("HC") amino acid sequence |
| Ab 886 | 1772 | DIVLTQSPSSLSASVGDRVTITCRASQSISRYLSWYQQKPGKAPKLLIYAAFSLQTGVP SRFSGSGSGTDFTLIISSFQTEDSATYYCQQSYSAPVTFGGGTKVEIK | ADI-41626 | Light chain variable region ("LC") amino acid sequence |
| Ab 887 | 1773 | QVQLQQWGPGLVKPSETLSLSCAVSGGSLRGHFWSWIRQPPCKGLEWIGEINHG GRTNFNPSLKSRLTISEDSKNQFSLKLSSVTAADTAVYYCARRWGYDSSGYYFFDY WGQGTLVTVSS | ADI-41644 | Heavy chain variable region ("HC") amino acid sequence |
| Ab 887 | 1774 | EIQMTQSPATLSVSPGERATLSCRASQTLGFNLAWYQQKPGQSPRLLIYGASTRAT GIPARFSGSGSGTEFTLTISSLQSEDFAVYFCQQYSNYYTFGQGTKVEIK | ADI-41644 | Light chain variable region ("LC") amino acid sequence |
| Ab 888 | 1775 | EVQLVQSGAEVKKPGSSVKVSCKASGFTFSRNAISWVRQAPGQGLEWMGGIIPIF GAANYPQKFQGRVTITADKSTSTAYMELSSLRSEDTALYYCARTMGEMTTPVSIYY YGMDVWGQGTTVTSS | ADI-41660 | Heavy chain variable region ("HC") amino acid sequence |
| Ab 888 | 1776 | QSVLTQPPSVSVSAAPGQKVTISCSGSSSNIGINYVSWYQQLPGTAPKLLIYDNNKRPS GIPDRFSGSKSGTSATLGITGLQTGDEADYYCGTWDSSLSAGYVFGSGTKLTVL | ADI-41660 | Light chain variable region ("LC") amino acid sequence |
| Ab 889 | 1777 | QVQLVQSGAEVKKAGESLKISCKGPRHSFTSYWIGWVRQMPGKGLEWMASIYPG DSDSRYSPSFEGQVTIISADKSIDTAFLQWSSLKASDTAMYFCARVYGAVPGGNWYF DLWGRGTLVTVSS | ADI-41662 | Heavy chain variable region ("HC") amino acid sequence |
| Ab 889 | 1778 | SYELIQLPSVSVSPGQTARITCSGDALPKKYAYWYQQKSGQAPVEDEGDYYCYSTDSTGDHRGVFGGGTKLTVL | ADI-41662 | Light chain variable region ("LC") amino acid sequence |
| Ab 890 | 1779 | EVQLVQSGDEVKKPGASVKVSCKASGYPFSTYGISWVRQAPCGQGLEWMGWIGVY TGGTNYAQKFQGRVLTIDTSTSTAYMELRSLRSDDTAVYYCARGTGSYMTATYFD YWGQGTLVTVSS | ADI-41664 | Heavy chain variable region ("HC") amino acid sequence |
| Ab 890 | 1780 | SYELTQPPSVSVAPGQTARITCGGNNIGSKAVHWYQKPGQAPVLVVYDDYDRPS GIPERFSGSNSGNTATLTISRVEAGDEADYYCQVWDSSSDYVFGTGTKLTVL | ADI-41664 | Light chain variable region ("LC") amino acid sequence |
| Ab 891 | 1781 | QVTLKESGPALVKPTQTLTLTCTFSGFSLSTSRMCVSWIRQPPGKALEWLARIDWD GDIYYSTLRTRLTISKDTSKNQVVLTMTNMDPVDTATYYCARTSIYATGGYYLYSD YWGQGTLVTVSS | ADI-41677 | Heavy chain variable region ("HC") amino acid sequence |
| Ab 891 | 1782 | EIVMTQSPSSLSASVGDRVTIICRASQSIASYVNWFQQKPGKAPKLLIYAASNVHSG VPSRFSGSGSGTGFTLTISSLQPEDSAIYYCQQSYTTPWTFGQGTKLEIK | ADI-41677 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 892 | 1783 | EVQLVESGGGVVQPGGSLRLSCAASGFTFRTYGMHWVRQAPGKGLEWVAVISYD GSNKYYADSLMGRFTISRDNSKNTLYLQMNSLRAEDTAVYYCAKCFVPGSGGWYE YYFDYWGQGTLVTVSS | ADI-41678 | Heavy chain variable region ("HC") amino acid sequence |
| Ab 892 | 1784 | QSVLTQPPSASGSPGQSVTISCTGTSSDVGGYNYVSWYQQHPGKAPKLMIYEVSKR PSGVPDRFSGSKSGNTASLTVSGLQAEDEADYYCSSYAGINNSVLFGGGTKLTVL | ADI-41678 | Light chain variable region ("LC") amino acid sequence |
| Ab 893 | 1785 | QVQLVQSGAEVKKPGESLRISCKGSGYSFSSHWIGWVRQMPGKGLEWMGIIYPGD SDTRYSPSFQGHVTISADKSISTAYLRWSSLKASDTAIYYCAKRMVGDYYGMNLWG QGTTVTVSS | ADI-41690 | Heavy chain variable region ("HC") amino acid sequence |
| Ab 893 | 1786 | EIVMTQSPSSLSASVGDRVTITCQASQDISNRLNWYQQKPGKAPKLLIYDASNLETG VPSRFSGSGSGTDFTFTISSLQPEDIATYFCQQYDYLLWFTFGPGTKVDIK | ADI-41690 | Light chain variable region ("LC") amino acid sequence |
| Ab 894 | 1787 | QVQLVQSGAEVKKPGESLKISCQASGYSFTTYWIGWVRQTPGKGLEWMGIIYPGD SDTRYTPSFQGQVTISADKSISTAYLHWSSLKASDTAMYYCARLSGGYTFGPDYWGL GTLVTVSS | ADI-41701 | Heavy chain variable region ("HC") amino acid sequence |
| Ab 894 | 1788 | NFMLTQPHSVSESPGKTVTISCTRSSGNIARYYVQWYQQRPGRAPTTVIYEDDQRP SGVPDRFSGSIDRSSNSASLTISGLKTEDEADYYCQSYDASNYFATGTKVTVL | ADI-41701 | Light chain variable region ("LC") amino acid sequence |
| Ab 895 | 1789 | EVQLLESGGGLVKPLQTLSLTCAVSGGSISSGGYSNSWIRQPPGKGLEWIGYIPSGS TYYNPSLKSRVTMSIDRSKNQPSLRLTSVTAADTAVYYCARGDGNDFWSADSSHAF AIWGQGTMVTVSS | ADI-41703 | Heavy chain variable region ("HC") amino acid sequence |
| Ab 895 | 1790 | EIVMTQSPGILSLSPGERATLSCRASQIVGNSYLAWYQQKPGQAPRLLIYGASSRAT GIPERFSGSGSGTDFTLTISRLEPEDFAVYHCQQYGSSPWTFGQGTKVEIK | ADI-41703 | Light chain variable region ("LC") amino acid sequence |
| Ab 896 | 1791 | QVQLVESGGGVVQPGRSLRLSCAASGFTFSSYGMHWVRQAPGKGLEWVSVIWFD GSKKYYEDSVKGRFTISRDNSKNTLYLEMNSLRAEDTAVYYCAREAPVRLGELSLYGY FDYWGQGTLVTVSS | ADI-41720 | Heavy chain variable region ("HC") amino acid sequence |
| Ab 896 | 1792 | DIQMTQSPSTLSASVGDRVTITCRASQSFSSWLAWYQQKPGKAPKLLIYDASTLESG VPSRFSGSGSGTEFTLTISSLQPDDFATYYCQQYNSYSWTFGQGTKLEIK | ADI-41720 | Light chain variable region ("LC") amino acid sequence |
| Ab 897 | 1793 | QVQLQESGPGLVKPSQTLSLTCTVSGGSMISGDFYWSWIRQPPGKGLEWIGYIYYS GTTYYSPSLKSRVSMSIDTSKSQFSLKLSSVTAADTAVYYCARKYSYGEKAYHYWGQ GTLVTVSS | ADI-41737 | Heavy chain variable region ("HC") amino acid sequence |
| Ab 897 | 1794 | EIVLTQSPGTLSLSPGERATLSCRASQTVGNNYLAWYQQKPGQAPRLLIYGASSRAT GIPDRFSGSGSGTDFTLTISRLESEDFAVYHCHQYGTSPQTFGQGTKVEIK | ADI-41737 | Light chain variable region ("LC") amino acid sequence |
| Ab 898 | 1795 | EVQLVESGGGLVKPSQTLSLTCVSVSGGSISSGGYSNSWIRQPPGKGLEWIGFIYNTG STYSNPSLKSRLTLSVDRSNNRFSLKLNSVTAADTGVYFCARSGNVRQCDATGHCST NYYFEYWGLGTLVTVSS | ADI-41743 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 898 | 1796 | EIVMTQSPATLSVSPGERATLSCRASQSVSSNLAWYQQKPGQAPRLLIYGASTRAT GIPARFSGSGSGTEFTLTISSLQSEDFAVYYCQQHDDWPPLTFGGGTKVEIK | ADI-41743 | Light chain variable region ("LC") amino acid sequence |
| Ab 899 | 1797 | EVQLLESGGGVVQPGRSLRLSCAASGLSFNSFGMHWVRQAPGKGLEWVAVIAYD GSNKYYADSVKGRFSISRDNSKNTLYLQMDSLRAEDTAVYYCAKAEAPNFSWSGYL SAFDIWGQGTTVTVSS | ADI-41756 | Heavy chain variable region ("HC") amino acid sequence |
| Ab 899 | 1798 | QPVLIQPASVSGSPGQSVIVSCTGTSDDVGDYNYVSWYQQHPGKAPKLLIPEVSD RPSGVSTRFSGSKSGNTASLTISGLQTEDEADYYCSSYTSRNLYVFGTGTKVTVL | ADI-41756 | Light chain variable region ("LC") amino acid sequence |
| Ab 900 | 1799 | EVQLVESGGGLVQPGRSLRLSCAASGFTFGDYAMHWVRQAPGCKGLEWVSGIITW NSGRVVYADSVKGRFTISRDNAKNSLYLQINSLRAEDTALYYCVKGSCNGGICYSAD YWGQGTLVTVSS | ADI-41768 | Heavy chain variable region ("HC") amino acid sequence |
| Ab 900 | 1800 | NFMLTQPHSVSESPGKTVTISCTRSSGSIARNFVHWYQQRPGSSPTTVIYEDNQRPS GVPGRFSGSIDSSSNSASLTISGLRSEDEADYYCQSYDSDNWFGGGTKLTVL | ADI-41768 | Light chain variable region ("LC") amino acid sequence |
| Ab 901 | 1801 | EVQLLESGGGLVEPGTSLRLSCEAASGFTFSDYYMSWIRQAPGKGPEMVADISSRGV VTYYADSVKGRFTISRDNAKNSLYLQINSLGAEDTAVYYCARLREVTYIMPTIDYFDY WGQGTLVTVSS | ADI-41772 | Heavy chain variable region ("HC") amino acid sequence |
| Ab 901 | 1802 | SYELTQPPSVSVSPGQTARITCSGDAFVKKYAYWHQKSGQAPVVVIYEDTKRPSGI PERFSGSSGTTATLTISGAQVEDEGDYYCYSRDFSGDHGVFGGGTKLTVL | ADI-41772 | Light chain variable region ("LC") amino acid sequence |
| Ab 902 | 1803 | QVQLVESGGGQGQPGRSLRLSCAASGFTFDDYAMHWVRQVPGKGLEWVSGIN WNSGYIGYADSVKGRFTISRDNAKNSLYLQMNSLRAEDTALYYCAKANNPIDSSGY NRGFDTWGQGTLVTVSS | ADI-41778 | Heavy chain variable region ("HC") amino acid sequence |
| Ab 902 | 1804 | QSALTQPRSVSGSPGQSVTICTGTSSDVGGYNYVSWYQQHPGKAPKLMIYDVNK RPSGVPDRFSGSKSDNTASLTISGLQAEDESDYFCCSYAGTYTWVFGGGTKVTVL | ADI-41778 | Light chain variable region ("LC") amino acid sequence |
| Ab 903 | 1805 | QVQLVQSGAEVRKPGASVKVSCKAFGTFTNFAISWVRQAPGQGLEWMGWIGP YNGDTYEQKFQGRVTMTADTSSSTVFMELRSLRFDDTAVYYCARGKGSTIPLGYYI GMDVWGQGTTVTVSS | ADI-41781 | Heavy chain variable region ("HC") amino acid sequence |
| Ab 903 | 1806 | ETTLTQSPSSLSASVGDRVTMTCRASQGISNYLAWYQQKPGKPPKLLIYLASSLQSG VPSRFSGSGSGTDFTLTISSLQPEDVATYYCQKYNSAPLTFGGGTKLEIK | ADI-41781 | Light chain variable region ("LC") amino acid sequence |
| Ab 904 | 1807 | QVQLVQSGDEVKKPGASVKVSCKSSGYTFTHFGVSWVRQAPGQGLEMMGWISG YNGNTNVAQKLQGRVTMTTDTSTTAYMELTSLRSDDTAVYYCARDSPAGTVTLD FWGQGTTVTVSS | ADI-41783 | Heavy chain variable region ("HC") amino acid sequence |
| Ab 904 | 1808 | DIVMTQSPLSLPVTLGQPASISCRSSQSLVYSDGNTYLNWFQQRPGQSPRRLIYKVS NRDSGVPDRFSGSGSGTDFTLKISRVEAEDVGVYYCMHGTHWPPEYTFGQGTKVE IK | ADI-41783 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 905 | 1809 | EVQLLESGGGVVQPGRSLRLSCAASGFTFSSSGMHWVRQAPGKGLEWVAIISSDGSKHYYADSVKGRFTISRDNSKNTLYLEMNSLRAEDSAVYYCAREGVWSGFFVDTGTDFRHHGMDVWGQGTTVTVSS | ADI-41787 | Heavy chain variable region ("HC") amino acid sequence |
| Ab 905 | 1810 | SYELTQPPSVSVSPGQTARIICSGDALPKKFAFWYQQKSGQAPLLVIHEDNKRPSGIPERFSGSSSGTLATLTISGAQVEDEADYYCYSIDTSANLGVFGGGTKLTVL | ADI-41787 | Light chain variable region ("LC") amino acid sequence |
| Ab 906 | 1811 | QVQLVQSGAEVKKPGASVKVSCQASGYTLTYDINWVRQAPGQGLEWMGWMNANSGNTGYAQKFQGRVTMTRNISISTAYMELSSLGPEDTAVYYCARGFYKMNDWSFDYWGQGTLVTVSS | ADI-41788 | Heavy chain variable region ("HC") amino acid sequence |
| Ab 906 | 1812 | QSVLTQPPSVSVAPGQTARITCGGNNIGSKSVHWYQQKPGQAPVLVVYDDSDRPSGIPERFSGSNSGNTAPLTISRVEAGDEADYYCQVWDGDSAHHAVFGGGTQLTVL | ADI-41788 | Light chain variable region ("LC") amino acid sequence |
| Ab 907 | 1813 | QVQLVQSGAEVKKPGSSVKVSCKASGGTFSNYGISWVRQAPGQGLERLGGIIPIYGTANHAQNFQGRVTIADESTSTAYMELSSLRSEDTAVYYCARDGTFVRYGMDVWGQGTTVTVSS | ADI-41790 | Heavy chain variable region ("HC") amino acid sequence |
| Ab 907 | 1814 | EIVLTQSPATLFLSPGERATLSCRASQSVSNYLAWFQQKPGQAPRLLIYDTSIRATGIPARFSGSGSGTDFTLTISSLEPEDFAFYYCQQRSNWPPTFGGGTKLEIK | ADI-41790 | Light chain variable region ("LC") amino acid sequence |
| Ab 908 | 1815 | QVQLVQSGGGLVKHGGSLRLSCAASGFTFSSYSMNWVRQAPGKGLEWASSISSSSSYIYYADSVKGRFTISRDNAKNSLYLQMNSLRAEDTAVYYCARTEYSSSSPIFDYWGQGTLVTVSS | ADI-41792 | Heavy chain variable region ("HC") amino acid sequence |
| Ab 908 | 1816 | QSVLTQPPSVSGAPGQRVTISCTGSSSNIGAGYDVHWYQQLPGTAPKLLITYGNSNRPSGVPDRFSGSKSGTSASLAITGLQAEDEADYYCQSYDSSLSGSVFGGGTKVTVL | ADI-41792 | Light chain variable region ("LC") amino acid sequence |
| Ab 909 | 1817 | EVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGTRTIVYCDGDCYQPWAYHYYGMDVWGQGTTVTVSS | ADI-41794 | Heavy chain variable region ("HC") amino acid sequence |
| Ab 909 | 1818 | QSVVTQEPSVSAAPGQKVTISCSGGSSNIGNNYVSWYQHLPGTAPKLLIYDNDKRPSGIPDRFSGSKSGTSATLGITGLQTGDEADYYCGTMDSSLSAVVFGGGTKLTVL | ADI-41794 | Light chain variable region ("LC") amino acid sequence |
| Ab 910 | 1819 | QVQLVQSGAEVKKPGSSVKVSCQASGGTFSTHALSWVRQTPCHGLEWVGVLPVFGATKYPRKFQGRVTITADKSTNTAYMELSSLRSDDTAVYYCARVVVHSTITTAKDFFSGVHDIWGQGTMVTVSS | ADI-41799 | Heavy chain variable region ("HC") amino acid sequence |
| Ab 910 | 1820 | DIRMTQSPSTLSASVGDRVTITCRASQTVSSWLAWYQQKPGKAPKLLIYQASSLESGVPSRFSGSGSGTEFTLTISGLQPDDFATYFCQHYNSYSPVTFGGGTKVEIK | ADI-41799 | Light chain variable region ("LC") amino acid sequence |
| Ab 911 | 1821 | QVQLVQSGAEVKKPGASVKVSCKASGYTFTDYYMHWVRQAPGQGLEWLAWINPYTGGTNYAQKFQGRVTLTRDTSVSTTYMEVTRLRSDDTAVYYCARGESFHHWGQGTLVTVSS | ADI-41800 | Heavy chain variable region ("HC") amino acid sequence |
| Ab 911 | 1822 | QSALTQPASVSGSPGQSITISCTGTSSDIGGYDVSWYQQHPGKVPKLMIYEVSTRPSGVSIRFSGSKSGNTASLTISGLQAEDEADYYCSSYTRSTITSVVFGGGTKLTVL | ADI-41800 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 912 | 1823 | RCTLQQWGAGRVKPSETLSLTCAVYRGPFSGYYWSWIRQPPGKGLEWIGEINLGE TNPGGSTHYNPSLRRLSMSIDTSKKQFSLRVNSVTAADTAVYYCTRGPVSRIYDTS GSYSLNYYGMDVWGQGTTVTVSS | ADI-41803 | Heavy chain variable region ("HC") amino acid sequence |
| Ab 912 | 1824 | DIRMTQSPSSLSASVGDRVTITCRASQGIRNDLGWYQQKPGKAPERLIYPASSLQG GVPSRFIASGSGTEFTLTISNLQPEDFATYYCLQHNSYPRTFGQGTKVEIK | ADI-41803 | Light chain variable region ("LC") amino acid sequence |
| Ab 913 | 1825 | QVQLQQWGAGLLKPSETLSLTCSVLGGSFSGYYWTWIRQPPGKGLEWIGEITHDG SSNYNPSLNSRVTISVDTSNYQFSLKMRSVTAADTAVYYCARSPDLTIFGGLYFYGI SVWGQGTTVTVSS | ADI-41804 | Heavy chain variable region ("HC") amino acid sequence |
| Ab 913 | 1826 | DIQMTQSPSSLSASMGDRVTITCRASQDISNYLAWYQQKPGKVPNLLIYAASTLQG GVPSRFSGSGSGTDFFTLTISSLQPEDVAIYYCQKYKSAPRTFGQGTKVEIK | ADI-41804 | Light chain variable region ("LC") amino acid sequence |
| Ab 914 | 1827 | QVQLVQSGAEVKKPGESLKISCKASGYSFTSYWIAWVRQMPGKGLEWMGIIFPGD SDTRYSPSFQQGVTISADKSISTAYLQWSSLEASDTAMYYCAKSTYYYYGLDVWG QGTTVTVSS | ADI-41805 | Heavy chain variable region ("HC") amino acid sequence |
| Ab 914 | 1828 | QPVLTQPASVSGSPGQSITISCTGTSSDVGGYDYVSWYQQYPGKAPKLMIYEVSNR PLGVSNRFSGSKGYTASLTISGLQAEDETNYYCSSYTSSRTWVFGGGTKLTVL | ADI-41805 | Light chain variable region ("LC") amino acid sequence |
| Ab 915 | 1829 | EVQLLESGPALVKPTQTLTLTCTFSGFSLTTTRMSVSWIRQPPGKALEWLARIDWD DDKYYSTSLKTRLTISKDTSKNQVVLTMTNMDPVDTATYFCARVNVYAANGYYSYY LDYWGQGTLVTVSS | ADI-41807 | Heavy chain variable region ("HC") amino acid sequence |
| Ab 915 | 1830 | DIVMTQTPSSSLSASVGDRVTITCRTSQSSSRYLNWYQKEPGKAPRLLIYLASALRSGV PSRFSGSGSGTDFTLTISSLQSEDFATYYCQQTYSIPWTFGQGTKVEIK | ADI-41807 | Light chain variable region ("LC") amino acid sequence |
| Ab 916 | 1831 | QVQLVQSGAELKKPGSSVRISCKVSGVTSDNYAITWVRQAPGQGLEWMGRVIPIF PVPQYAQKFQGRVTLSADKSTRTAYLEHSLRSEDTATYYCATHRPSDSWGQGTLV TVSS | ADI-41808 | Heavy chain variable region ("HC") amino acid sequence |
| Ab 916 | 1832 | DIRVTQSPSTLSASVGDRVTITCRASQNINSWLAWYQQKPGKAPKLLIFKASSLESG VPARFSGSGFGTEFTLTITSLQPDDFASYYCQQYDTYPYPFGQGTKVEIK | ADI-41808 | Light chain variable region ("LC") amino acid sequence |
| Ab 917 | 1833 | QVTLKESGGGLVQPGGSLRLSCAASGFTFSNYAMSWVRQAPGKGLEWVSAISHSD SRTFYADSVKGRFTISRDNSKNTLFLQMDSLRAHDTAVYYCANVDPSSVTYYGYYYG MDVWGQGTTVTVSS | ADI-41809 | Heavy chain variable region ("HC") amino acid sequence |
| Ab 917 | 1834 | QSVLTQPPSASGTPGQRVTISCSGSSNIGKNFVWYQQFPGTAPKRLIYRNNQRP SGVPDRFSGSRSGTSASLAISGLRSEDEADYYCATWDDSLSGWVFGGGTKLTVL | ADI-41809 | Light chain variable region ("LC") amino acid sequence |
| Ab 918 | 1835 | QVQLVQSGGGVVQPGRSLRLSCAASGFNFHNYAMHWVRQAPGKGLEWVAVLSY DGGNKHYADSVKGRFTISRDNSKNTLYLQMNSLRPDDTAVYYCARGHSDWRGDY FDFWGQGTLVTVSS | ADI-41810 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 918 | 1836 | DIQLTQSPATLSVSPGERAILSCRASQNVGTNLAWYQQKPGQAPRLLIYDASTRATGIPARFSGSGAGTDFTLTISGLQSEDFAVYYCQQYINWPPYTFGQGTKLEIK | ADI-41810 | Light chain variable region ("LC") amino acid sequence |
| Ab 919 | 1837 | QVQLQQSGPRLVKPSHTLSLTCVISGDSVSSGSAAMSWIRQSPSRGLEWLGRTYYRSKWYDYAVSVKGRIIQPDTSKNQFSLQLNSVSPEDTAVYYCARDPDSGNYFHYYGMDVWGQGTTVTVSS | ADI-41811 | Heavy chain variable region ("HC") amino acid sequence |
| Ab 919 | 1838 | DIVMTQSPATLSLSPGERATLSCRASQSVDYFAWYQQKPGQAPRLLIYDASKRASGVPARFSGSGSAGTDFTLTISSLEPEDFAVYYCQQRAKWPPYTFGQGTKLEIK | ADI-41811 | Light chain variable region ("LC") amino acid sequence |
| Ab 920 | 1839 | EVQLVESGGLVKPGGSLRLSCAASGFTFSSYSMNWVRQAPGKGLEWVSSISAGSSYTDYADSVKGRFTISRDNAKNSLYLKMNSLRAEDTAVYYCARDPGYCSSNSCTVAMDVWGQGTTVTVSS | ADI-41812 | Heavy chain variable region ("HC") amino acid sequence |
| Ab 920 | 1840 | SYELTQPPSVSGAPGQRVTISCTGSSNIGAGYDVHWYQQLPGTAPKLLIYGNNNRPSGVPDRFSGSKSGTSASLAITGLQAEDEADYYCQSYDRTLVIFGGGTKLTVL | ADI-41812 | Light chain variable region ("LC") amino acid sequence |
| Ab 921 | 1841 | EVQLLESGPTLVKPTQTLTLTCTFSGFSLSTFGVGVGWIRQPPGKALECLALIYWDDDKRYSPSLKSRLTITRDTSKNQVVLTMTNMDPVDTATYYCAHRRSSTVTTGFFDYWGRGTLVTVSS | ADI-41814 | Heavy chain variable region ("HC") amino acid sequence |
| Ab 921 | 1842 | QPVLTQPPSVSGAPGQRVTVSCTGNSSNIGAGHGAHWYQQLPGTAPKLLIYGSTDRPSGVPDRFFGSQSGTSASLVITELREADEADYYCQSFDSSLLSIWFGGGTKLTVL | ADI-41814 | Light chain variable region ("LC") amino acid sequence |
| Ab 922 | 1843 | EVQLLESGGGLVKPGGSLRLSCGASGFTFSTSSFNMVRQAPGKGLEWVSSISSTSSYVFYADSVKGRFTVSRDNAQNSLYLQMNSLRAEDTAVYYCARARGVGATIGFDYWGQGTLVTVSS | ADI-41815 | Heavy chain variable region ("HC") amino acid sequence |
| Ab 922 | 1844 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK | ADI-41815 | Light chain variable region ("LC") amino acid sequence |
| Ab 923 | 1845 | QVQLVQSGAEVKKPGASVKVSCEAASGYTFTDSYIHWVRQAPGQGLEWMGWINPNSGGTNYAQKFQGRVTMTRDTSTSTAFIELSRLRSDDTAVYYSARGVRQQWLVNTGDPDYYFDFWGQGTLVTVSS | ADI-41816 | Heavy chain variable region ("HC") amino acid sequence |
| Ab 923 | 1846 | SYVLTQPPSVSVSPGQTASITCSGDKLGDKYSCWYQQKPGQSPVLVIYQDYKRPSGIPERFSGSNSGNTATLTISGTQAMDEADYYCQAWDRNAGVFGTGTKLTVL | ADI-41816 | Light chain variable region ("LC") amino acid sequence |
| Ab 924 | 1847 | QVQLVQSGAEVKKPGESLKISCKGPGYSFTTYWIGWVRQMPGKGLEWMGIIYPGDSDTKYSPSFQGQVTITADKSIATAYLQWSRLKASDTAVYYCATVVTYADNIRWFDSWGQGTLVTVSS | ADI-41817 | Heavy chain variable region ("HC") amino acid sequence |
| Ab 924 | 1848 | QSALTQPASVSGSPGQSITISCTGTSGDVGGYKFVSWYQHHPGKAPKLVIYDVANRPSGVSDRFSGSKSGTTASLTISGLQAEDEADYYCSSYTSSSTYVFGTGTKVTAL | ADI-41817 | Light chain variable region ("LC") amino acid sequence |
| Ab 925 | 1849 | EVQLVESGGGLVQPGGSLRLSCAASGFTVNTNYMSWVRQAPGKGLEWVSIIYSSGSTSYADSVKGRFTISRDNSENTLYLQMHTLRAEDTAVYYCVRERTPFYVSSGYWDSWGQGTLVTVSS | ADI-41818 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 925 | 1850 | EIVLTQSPGTLSLSPGERATLSCRASQSVDSSYLAWYQQKPGQAPRLLIFGASSRATG IPDRFSGSGSGTDFTLTISRLEPEDFAVYYCQQYGFSYTFGQGTKVEIK | ADI-41818 | Light chain variable region ("LC") amino acid sequence |
| Ab 926 | 1851 | EVQLVESGGGVVQPGRSLRLSCAVSGFTFSTYGMHWVRQTPGRGLEWVAVLSYD GNHKYYADSVMGRFTISRDNSKDTLYLQVNSLRPEDSAVYYCAKDRIHCPNGVCYV HSSFYGLDVWGQGTTVTVSS | ADI-41820 | Heavy chain variable region ("HC") amino acid sequence |
| Ab 926 | 1852 | QTVVTQEPSLIVSPGGIVTLICGSSTGAVTSGHYPYWLQQKPGQAPRTLIYDTTNK DSWTPARFSGSLLGGKAALTLSGAQPDEAQYYCLLSENGPYWVFGGGTKVTVL | ADI-41820 | Light chain variable region ("LC") amino acid sequence |
| Ab 927 | 1853 | EVQLSESAGGVVQPGGSLRLTCAASGFSFSTNGMHWVRQAPGKGLEWVAFIRYD GSKKYYAESVKGRFTISREDSNNTLYLQMNSLRPEDTAVYYCAKEDCSGGTCYHERN YYYYGMDVWGQGTTVTVSS | ADI-41827 | Heavy chain variable region ("HC") amino acid sequence |
| Ab 927 | 1854 | QPVLTQPPSLPVSPGQTASITCSGDKLEYKYACWYQHKPGQSPVLVIYQDNKRPSGI PERFSGSGSNSGNTATLRIISGTQPMDEADYYCQAWDSSTVVFGGGTKVTVL | ADI-41827 | Light chain variable region ("LC") amino acid sequence |
| Ab 928 | 1855 | EVQLVESGGGLVQPGGSLRLSCADSDFTFSTYSMNWVRQAPGKGLEWISYITGRSS AIYADSVKGRFTISRDNAKNSLFLQMNSLRAEDTAVYYCTTFMAGYSFGHGDAFD IWGQGTTVTVSS | ADI-41828 | Heavy chain variable region ("HC") amino acid sequence |
| Ab 928 | 1856 | SYELTQPPSVSVAPGQTARITCGGNNIGSKSVHWYQQKPGQAPVLVVYDDSDRPS GIPERFSGSNSGNTATLTISRVEAGDEADYYCQVWNSNSDHPHWVFGGGTQLTVL | ADI-41828 | Light chain variable region ("LC") amino acid sequence |
| Ab 929 | 1857 | EVQLVESGGGLVKPGGSLRLSCAASGFTSSGYNMMWVRQAPGKGLEWVSSLSGSS SYIHYADSVKGRFTISRDNAKNSLYLQMNSLRAEDTAVYYCATVGALPGHEDHNWG QGTLVTVSS | ADI-41829 | Heavy chain variable region ("HC") amino acid sequence |
| Ab 929 | 1858 | QAVVTQEPSVSGAPGQRVTISCTGSSSNIGAGYDVHWYQQLPGTAPKLLIYDNTNR PSGVPDRFSGSKSGTSASLAITGLQAEDEADYYCQSYDSRLTYVFGTKVTVL | ADI-41829 | Light chain variable region ("LC") amino acid sequence |
| Ab 930 | 1859 | QVQLVQSGPAVKKPGASVKVSCKASGYIFTSYGVSWVRQAPGQGLEWMGWISGY NGNTDYAQKFQGRVTLTVDSSTGTVYMDLRSLRSDDTAIYYCARAPPLPGQVYDG AGSYLLHGYWGQGTLVTVSS | ADI-41830 | Heavy chain variable region ("HC") amino acid sequence |
| Ab 930 | 1860 | DIVMTQSPLSLPVTPGEPASISCRSSQSLLHSNGYNYLDWYLQKPGQSPQLLIYLGSN RASGVPDRFSGSGSGTDFTLKISRVEAEDVGVYYCMQALQTPRTFGQGTKVEIK | ADI-41830 | Light chain variable region ("LC") amino acid sequence |
| Ab 931 | 1861 | EVQLLESGGGLVKPGGSLRLSCAASGFTFSSYAMHWVRQPPGKGLEWVSSISASSS FINYADSVKGRFTISRDGARNSLYLQMNSLRAEDTAVYYCVREDYDSSGYGLHWFD PWGQGTLVTVSS | ADI-41831 | Heavy chain variable region ("HC") amino acid sequence |
| Ab 931 | 1862 | SYVLTQPPSVSGAPGQRVTISCTGSSSNIGAGYDVHWYQQFPGTAPKLLMYGNTN RPSGVPDRFSGSKSGTSASLAITGLQAEDEADYYCQSYDRSLSGWVFGGGTKLITVL | ADI-41831 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 932 | 1863 | EVQLVESGGGLVQPGGSLRLSCAASGFTFSKYAMMWVRQAPGKGLEWVSSISDSG DSRYYADSVKGRFTISRDSSKNTLNLQMNSLRAEDTAVYYCAKAGWELFSPQGAFD LWGQGTMVTVSS | ADI-41832 | Heavy chain variable region ("HC") amino acid sequence |
| Ab 932 | 1864 | EIVMTQSPGTLSLSPGERATLSCRASQSVSSSHLAWYQQKPGQAPRLLIYGASSRDS GIPDRFSGSGSGTDFTLSISRLEPEDFAVYYCQHYGNSPYTFGQGTKVDIK | ADI-41832 | Light chain variable region ("LC") amino acid sequence |
| Ab 933 | 1865 | EVQLLESGGGLVQPGGSLRLSCAASRFTFSTYAMSWVRQAPGKGLEWVSSISGSG DKTFYTDSVKGRFTISRDNSKNTLYLQMNSLRAEDTAVYYCARESYYELWTGTYPG WELDYWGQGTLVTVSS | ADI-41833 | Heavy chain variable region ("HC") amino acid sequence |
| Ab 933 | 1866 | DIQLTQSPSSLSASVGDRVTITCRASQDISNYLAWYQQKPGKPPKLLIYAASILESGAP SRFSGSGSGTDFTLIISSLQPEDVGTYYCQKSNSAPRPFGQQTKVEIK | ADI-41833 | Light chain variable region ("LC") amino acid sequence |
| Ab 934 | 1867 | EVQLLESGGRLVQPGRSLRLSCAASGFTVSGSYSMSWVRQAPGCKGLEWVSVIYIDG GTKYADSVKGRFTISRDNSKNTVYLQMNSLRAEDTAVYYCARDSSLMYRGGDYWG QGTLVTVSS | ADI-41834 | Heavy chain variable region ("HC") amino acid sequence |
| Ab 934 | 1868 | DIQMTQSPSSLSLSASVGDRVTITCQANHDISNYLNWYQQKPGKAPKLLIYDASILEAG VPSRFSGSGSGTHFTFTISSLQPEDIATYYCQQFDRFRALIPGGGTKVEIK | ADI-41834 | Light chain variable region ("LC") amino acid sequence |
| Ab 935 | 1869 | EVQLLESGGGLVQPGGSLRLSCAASGFTFSSYAMMWVRQAPGKGLEWVSSIISDSG GSTYYADSVKGRFTISRDNSKNTLYLQMNSLRAEDTAVYYCAKATPLKWELLIGSTP GYYFDYWGQGTTVTVSS | ADI-41835 | Heavy chain variable region ("HC") amino acid sequence |
| Ab 935 | 1870 | SYELTQLPSVSVSPGQTASITCSGDKLGDKYACWYQQKPGQSPVVIMYQDNKRPS GIPERFSGSNSCNTALTISGTQAMDEADYYCQAWDSSTGVFGGGTKVTVL | ADI-41835 | Light chain variable region ("LC") amino acid sequence |
| Ab 936 | 1871 | EVQLLESGAEVKKPGASVKVSCRASGYTFTSNTLHWVRQAPGQGLEWMGWINAD NGNTRYSQKFQGRVTITRDTSANTAYMELSSLISEDTAVYYCAREWSGFWSGLNW FEPWGQGTLVTVSS | ADI-41836 | Heavy chain variable region ("HC") amino acid sequence |
| Ab 936 | 1872 | QSVLTQPPSVSGAPGQRVTISCTGSSSNIGSGNDVHWYQQFPGTAPKVLIYVNSIRP SGVSDRFSGSKSGTSASLAITGLRAEDEADYYCQSYDSSLNGVAFGGGTKLTVL | ADI-41836 | Light chain variable region ("LC") amino acid sequence |
| Ab 937 | 1873 | QVQLVQSGAEVKKPGASVKVSCKASGYTMTDTATSTAYMELRSLRSDDTAVYYCARDAHCSSTNCYID LGGAPVDYWGQGTLVTVSS | ADI-41837 | Heavy chain variable region ("HC") amino acid sequence |
| Ab 937 | 1874 | DIVLTQTPLSLSVTLGQPASISCRSSQSLVVIDGYTYLNWFQQRPGQSPRRLIYKVSN RDSGVPDRFSGSGSGTDFTLKISRVEAEDVGVYYCMQGAHWPWTFGQGTKVEIK | ADI-41837 | Light chain variable region ("LC") amino acid sequence |
| Ab 938 | 1875 | EVQLLESGGGVVQPGRSLRLSCAASEFTFRSYAMHWVRQAPGMGLEWVAVTPYD GISKYYADSVKGRFTISRDNSKNTLYLQMNSLRPEDTAVYYCARGFPEPITSWPGYF YAMDVWGQGTTVTVSS | ADI-41838 | Heavy chain variable region ("HC") amino acid sequence |
| Ab 938 | 1876 | QSALTQPASVSGSPGQSITISCTGTTSDVGVYNYVSWYQQHPGKAPKLMIYDVSNR PSGVSNRFSGSKSGNTASLTIIGLQAEDEADYCCSSYTNSDTPVVFGGGTKLTVL | ADI-41838 | Light chain variable region ("LC") amino acid sequence |

TABLE 5-continued

Informal Sequence Listing

| Antibody No. | SEQ ID NO: | Sequence | Clone # (ADI) | Descriptors |
|---|---|---|---|---|
| Ab 939 | 1877 | EVQLLESGGGVVQPGGSLRLSCVASGFTFSAYGMHWVRQAPGKGPEWVAMTRS DGNKIYYADSVKGRFTISRDDSKNTLYLEMNSLRPDDTAVYFCAKEVGYGGNSLHY WGQGTLVTVSS | ADI-41839 | Heavy chain variable region ("HC") amino acid sequence |
| Ab 939 | 1878 | SYELIQPPSVSVAPGQTAKITCGGNNIGSKSVHWYQQKPGQAPVLVVFDDSDRPSG IPERFSGSNSGNTATLTISRVEAGDEADYYCQVWDFSSDLWFGGGTKLITVL | ADI-41839 | Light chain variable region ("LC") amino acid sequence |
| Ab 940 | 1879 | QVQLVQSGAEVKKPGSSVKVSCKASGDTFSGYAIYWVRQAPGRGLELMGGIIPILG TSSYAQRFLGRTSFTADESTSTAYMDLSSLTSADTAMYYCARKRVTVPVPDSWGQ GTLVTVSS | ADI-41840 | Heavy chain variable region ("HC") amino acid sequence |
| Ab 940 | 1880 | EIVMTQSPATLSVSPGERATLSCRASQSVSSNLAWTQQKLGQAPRLLIYGASTRAID IPARFSGSGSGTEFTLTISSLQSEDFVVYCQQYNNMPWTFGQGTKVEIK | ADI-41840 | Light chain variable region ("LC") amino acid sequence |
| Ab 941 | 1881 | EVQLLESGGGLVKPGGSLRLSCAASGFSFSYYSMNWVRQTPGKGLEWVSSISDRSS YISYADSVKGRFTISRDNAKNSLYLQMNSLRAEDTAVYYCARDQYESYAFDIWGQG TTVTVSS | ADI-41841 | Heavy chain variable region ("HC") amino acid sequence |
| Ab 941 | 1882 | DIQVTQSPSSLSASVGDRITITCQASQDVGNYLNWYQQKVGKAPKLLIHDASDLET GVPSRFSGSGSGTYTFTISSLQPEDFATYYCQPYDNLRPVTFGQGTRLEIK | ADI-41841 | Light chain variable region ("LC") amino acid sequence |
| Ab 942 | 1883 | QVQLVQSGAEVKKPGASVKVSCKASGYTFTHYDINWVRQAPGQGLEMGWINP NSGDTDYAQKFQGRVTMTVDTSISTAYLDLRSLTSADAAVYYCARGGAYAINGYYII WFDPWGQGTLVTVSS | ADI-41842 | Heavy chain variable region ("HC") amino acid sequence |
| Ab 942 | 1884 | DIVVTQSPSSLSASVGDRVTITCRASQSISRYLNWFQKKPGKAPHLLIYAASILQSEVP SRFSGSGSGTDFTLTISSLQPEDFATYYCQQSYNSPYTFGPGTKVDIK | ADI-41842 | Light chain variable region ("LC") amino acid sequence |
| Ab 943 | 1885 | QVQLQQWGAGLLKPSETLSLLTCAVYGGSFSGYYWSWIRQPPGKGLEWIGEINHSG STNYNPSLKSRVTISVDTSKNQFSLKLSSVTAADTAVYYCARGVPVLRYFDWLRFGY GMDVWGQGTTVTVSS | ADI-43638 | Heavy chain variable region ("HC") amino acid sequence |
| Ab 943 | 1886 | EIVMTQSPDSLAVSLGERATINCKSSQSVLYSSNNKNYLAWYQQKPGQPPKLLIYW ASTRESGVPDRFSGSGSGTDFTLTISSLQAEDVAVYYCQQYYSTPLTFGGGTKLEIK | ADI-43638 | Light chain variable region ("LC") amino acid sequence |
| Ab 944 | 1887 | QVQLVQSGSELKKPGASVKVSCKASGYTFTSYAMNWVRQAPGQGLEWMGWINT NTGNPTYAQGFTGRFVFSLDTSVSTAYLQISSLKAEDTAVYYCAAYGIHDAFDIWGQ GTMVTVSS | ADI-43639 | Heavy chain variable region ("HC") amino acid sequence |
| Ab 944 | 1888 | DIRLTQSPSSLSASVGDRVTITCRASQSISSYLNWYQQKPGKAPKLLIYAASSLQSGVP SRFSGSGSGTDFTLTISSLQPEDFATYYCQQSYSTPRTFGQGTKVEIK | ADI-43639 | Light chain variable region ("LC") amino acid sequence |
| Ab 945 | 1889 | QVQLVQSGGGLVKPGGSLRLSCAASGFTFSSYSMNWVRQAPGKGLEWVSSISSSS SYIYYADSVKGRFTISRDNAKNSLYLQMNSLRAEDTAVYYCAREGRDGYNYNFDIW GQGTLVTVSS | ADI-43640 | Heavy chain variable region ("HC") amino acid sequence |

TABLE 5-continued

Informal Sequence Listing

| Antibody No. | SEQ ID NO: | Sequence | Clone # (ADI) | Descriptors |
|---|---|---|---|---|
| Ab 945 | 1890 | QSVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGVVFGGGTKLTVL | ADI-43640 | Light chain variable region ("LC") amino acid sequence |
| Ab 946 | 1891 | EVQLVESGGGLVKPGGSLRLSCAASGFTFSDYYMSWIRQAPGKGLEWVSYISSSSSY TNYADSVKGRFTISRDNAKNSLYLQMNSLRAEDTAVYYCARDFSGQWLVLGYGM DVWGQGTTVTVSS | ADI-43641 | Heavy chain variable region ("HC") amino acid sequence |
| Ab 946 | 1892 | QSVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGPVFGGGTKLTVL | ADI-43641 | Light chain variable region ("LC") amino acid sequence |
| Ab 947 | 1893 | EVQLLESGGGLVKPGGSLRLSCAASGFTFSSYSMNWVRQAPGKGLEWVSSISSSSS YIYYADSVKGRFTISRDNAKNSLYLQMNSLRAEDTAVYYCARDGADSSYYYYMDVW GKGTTVTVSS | ADI-43642 | Heavy chain variable region ("HC") amino acid sequence |
| Ab 947 | 1894 | QAVVTQPPSVSGAPGQRVTISCTGSSSNIGAGYDVHWYQQLPGTAPKLLIYGNSNR PSGVPDRFSGSKSGTSASLAITGLQAEDEADYYCQSYDSSLSGSVFGGGTKLTVL | ADI-43642 | Light chain variable region ("LC") amino acid sequence |

EXEMPLARY EMBODIMENTS

1. An isolated antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRH3 amino acid sequence that is at least 80%, 85%, 90%, 95%, 96%, 97%, 98%, or 99% identical to a CDRH3 amino acid sequence of an antibody selected from Antibody Number 1 through Antibody Number 465 as disclosed in Table 5.

2. An isolated antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRH2 amino acid sequence that is at least 80%, 85%, 90%, 95%, 96%, 97%, 98%, or 99% identical to a CDRH2 amino acid sequence of an antibody selected from Antibody Number 1 through Antibody Number 947 as disclosed in Table 5.

3. An isolated antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRH1 amino acid sequence that is at least 80%, 85%, 90%, 95%, 96%, 97%, 98%, or 99% identical to a CDRH1 amino acid sequence of an antibody selected from Antibody Number 1 through Antibody Number 947 as disclosed in Table 5.

4. An isolated antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRL3 amino acid sequence that is at least 80%, 85%, 90%, 95%, 96%, 97%, 98%, or 99% identical to a CDRL3 amino acid sequence of an antibody selected from Antibody Number 1 through Antibody Number 947 as disclosed in Table 5.

5. An isolated antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRL2 amino acid sequence that is at least 80%, 85%, 90%, 95%, 96%, 97%, 98%, or 99% identical to a CDRL2 amino acid sequence of an antibody selected from Antibody Number 1 through Antibody Number 947 as disclosed in Table 5.

6. An isolated antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising a CDRL1 amino acid sequence that is at least 80%, 85%, 90%, 95%, 96%, 97%, 98%, or 99% identical to a CDRL1 amino acid sequence of an antibody selected from Antibody Number 1 through Antibody Number 947 as disclosed in Table 5.

7. The isolated anti-RSV F antibody of any one of embodiments 1 to 6, comprising (i) the CDRH3 amino acid sequence of an antibody selected from Antibody Number 1 through Antibody Number 947 as disclosed in Table 5; (ii) the CDRH2 amino acid sequence of an antibody selected from Antibody Number 1 through Antibody Number 947 as disclosed in Table 5; (iii) the CDRH1 amino acid sequence of an antibody selected from Antibody Number 1 through Antibody Number 947 as disclosed in Table 5; (iv) the CDRL3 amino acid sequence of an antibody selected from Antibody Number 1 through Antibody Number 947 as disclosed in Table 5; (v) the CDRL2 amino acid sequence of an antibody selected from Antibody Number 1 through Antibody Number 947 as disclosed in Table 5; (vi) the CDRL1 amino acid sequence of an antibody selected from Antibody Number 1 through Antibody Number 947 as disclosed in Table 5; or (vii) any combination of two or more of (i), (ii), (iii), (iv), (v), and (vi).

8. An isolated antibody or antigen-binding fragment thereof that cross-competes for binding or specifically binds to the same epitope(s) of a Respiratory Syncytial Virus (RSV) fusion glycoprotein (F) ("an anti-RSV F antibody") as an antibody or antigen-binding fragment thereof comprising (i) a heavy chain variable region ($V_H$) that is at least 80%, 85%, 90%, 95%, 96%, 97%, 98%, or 99% identical to a $V_H$ amino acid sequence of an antibody selected from Antibody Number 1 through Antibody Number 947 as disclosed in Table 5, and/or (ii) a light chain variable region ($V_L$) that is at least 80%, 85%, 90%, 95%, 96%, 97%, 98%, or 99% identical to a $V_L$ amino acid sequence of an antibody selected from Antibody Number 1 through Antibody Number 947 as disclosed in Table 5.

9. The isolated anti-RSV F antibody of embodiment 8, comprising (i) the $V_H$ amino acid sequence of an antibody selected from Antibody Number 1 through Antibody Number 947 as disclosed in Table 5; and/or (ii) the $V_L$ amino acid sequence of an antibody selected from Antibody Number 1 through Antibody Number 947 as disclosed in Table 5.

10. The isolated anti-RSV F antibody of any one of embodiments 1 to 9, which is selected from the group consisting of Antibody Number 1 through Antibody Number 947 as disclosed in Table 5.

11. The isolated anti-RSV F antibody of any one of embodiments 1 to 10, which binds to an epitope comprising site Ø, site I, site II, site III, site IV, or site V of RSVF.

12. The isolated anti-RSV F antibody of any one of embodiments 1 to 11, which binds to an epitope on prefusion F (preF), preferably antigenic site III.

13. The isolated anti-RSV F antibody of any one of embodiments 1 to 12, which binds to prefusion F (preF) with high affinity but does not bind to or binds with low affinity to postfusion F (postF).

14. The isolated anti-RSV F antibody of any one of embodiments 1 to 12, which binds to an epitope on postfusion F (post F), preferably antigenic site I.

15. The isolated anti-RSV F antibody of any one of embodiments 1 to 14, which does not compete with D25 for binding to RSV F.

16. The isolated anti-RSV F antibody of any one of embodiments 1 to 15, which competes with MPE8 and/or motavizumab for binding to RSV F.

17. The isolated anti-RSV F antibody of any one of embodiments 1 to 16, which is a neutralizing antibody.

18. The isolated anti-RSV F antibody of embodiment 17, which has a neutralizing activity ($IC_{50}$) of less than 100 µg/ml, 50 µs/ml, 25 µs/ml, 10 µg/ml, 5 µg/ml, 1 µg/ml, 0.5 µg/ml, 0.1 µg/ml, or 0.05 µg/ml.

19. The isolated anti-RSV F antibody of any one of embodiments 1 to 18, which binds to RSV prefusion F with a $K_D$ value of less than 50 nM, 25 nM, 10 nM, 5 nM, 1 nM, 0.5 nM, or
0.1 nM as measured by surface plasmon resonance.

20. The isolated anti-RSV F antibody of any one of embodiments 1 to 19, which binds to RSV prefusion F through one or both of the following interactions:
   a) Tyr33 in CDRL1 and Tyr93 in CDRL3 both contact the α6-α7 loop of RSV prefusion F; and
   b) five consecutive serine residues, preferably followed by a tyrosine residue (Tyr56), in CDRH2 form a network of hydrogen bonds with Asp310 on (36 of RSV prefusion F.

21. The isolated anti-RSV F antibody of any one of embodiments 1 to 20, which has a clean or low polyreactivity profile.

22. The isolated anti-RSV F antibody of any one of embodiments 1 to 21, which is a full-length IgG1 monoclonal antibody.

23. The isolated anti-RSV F antibody of any one of embodiments 1 to 22, which comprises a Fc region that has been modified to alter effector function, half-life, proteolysis, and/or glycosylation.

24. The isolated anti-RSV F antibody of any one of embodiments 1 to 23, which is derivatized.

25. An isolated nucleic acid sequence or nucleic acid sequences encoding an antibody or antigen-binding fragment thereof according to any one of embodiments 1 to 24.

26. An expression vector or vectors comprising the isolated nucleic acid sequence according to embodiment 25.

27. A host cell comprising the isolated nucleic acid sequence(s) according to embodiment 25 or the expression vector(s) according to embodiment 26.

28. The host cell of embodiment 27, which is a mammalian cell, a bacterial cell, a fungal cell, a yeast cell, or an insect cell.

29. A method for producing an isolated antibody or antigen-binding fragment thereof that specifically binds to Respiratory Syncytial Virus (RSV) fusion glycoprotein (F) ("an anti-RSV F antibody") comprising expressing the nucleic acid sequence(s) of embodiment 25 or culturing the host cell of embodiment 27 or 28 under conditions that provide for expression of the anti-RSV F antibody and optionally recovering the anti-RSV F antibody from the host cell and/or culture medium.

30. The method of embodiment 29, wherein the host cell is a yeast cell or a mammalian cell.

31. A pharmaceutical composition comprising (i) the anti-RSV F antibody of any one of embodiments 1 to 24, the nucleic acid sequence(s) of embodiment 25, the expression vector(s) of embodiment 26, or the host cell of embodiments 27 or 28; and (ii) a pharmaceutically acceptable carrier and/or excipient.

32. The pharmaceutical composition of embodiment 31 for use in preventing or treating a RSV infection in a subject.

33. The pharmaceutical composition of embodiment 32, wherein the subject is a human, preferably an infant.

34. A method of preventing or treating a Respiratory Syncytial Virus (RSV) infection in a subject, comprising administering to the subject in need thereof an effective amount of the anti-RSV F antibody of any one of embodiments 1 to 24, the isolated nucleic acid sequence(s) of embodiment 25, the expression vector(s) of embodiment 26, or the host cell(s) of embodiment 27 or 28, optionally in association with a further prophylactic and/or therapeutic agent.

35. The method of embodiment 34, wherein the further prophylactic and/or therapeutic agent is selected from an antiviral agent; a vaccine specific for RSV; a vaccine specific for influenza virus; a vaccine specific for metapneumovirus (MPV); an siRNA specific for a RSV antigen; an siRNA specific for a MPV antigen; a second anti-RSV antibody; an anti-MPV antibody; an anti-IL4R antibody; an anti-influenza antibody; and a NSAID.

36. The method of embodiment 34 or 35, wherein the subject is human, preferably an infant.

37. A method of preventing or treating a Respiratory Syncytial Virus (RSV) infection in a human subject, comprising administering to the subject in need thereof an effective amount of the pharmaceutical composition of any one of embodiments 31 to 33.

38. The method of embodiment 37, wherein the human subject is an infant.

39. A method for detecting a Respiratory Syncytial Virus (RSV) infection in a subject, comprising obtaining a sample from the subject; contacting the sample with the anti-RSV F antibody of any one of embodiments 1 to 24; and detecting the presence of a complex between the anti-RSV F antibody and the RSV fusion glycoprotein (F), wherein detection of the complex indicates the presence of RSV.

40. The method of embodiment 39, wherein the subject is a human, preferably an infant.

41. An isolated antibody or antigen-binding polypeptide comprising a VH CDR3 having an amino acid sequence according to an antibody number in Table 9B.

42. An isolated antibody or antigen-binding polypeptide comprising a VH CDR3 having an amino acid sequence according to an ADI listed in Table 8.

43. An isolated antibody or antigen binding polypeptide characterized by ability to neutralize respiratory syncytial virus (RSV).

44. An isolated antibody or antigen binding polypeptide characterized by high affinity binding to RSV F.

45. An isolated antibody or antigen binding polypeptide characterized by high affinity binding to RSV prefusion F (preF).

46. An isolated antibody having an amino acid sequence according to:
   (i) Antibody Number 2, 71, 112, 217, 227, 228, 249, 466, 467, 469, 470, 832, 471, 516, 527, 532, 543, 544, 551, 554, 571, 578, 581, 592, 615, 641, 843, 868, or 870;
   (ii) an Antibody Number of (i) with no more than 3 amino acid substitutions, additions, or deletions;
   (iii) an Antibody Number of (i) with no more than 3, 2, or 1 amino acid substitution(s), addition(s), or deletion(s) in a CDR; or
   (iv) an Antibody Number of (i) with no more than 3, 2, or 1 amino acid substitution(s), addition(s), or deletion(s) in CDRH3.

47. An antibody or antigen-binding polypeptide according to any preceding embodiment having an $IC_{50}$ of less than 300 pM for neutralization of RSV.

48. An antibody or antigen-binding polypeptide according to any preceding embodiment having an $IC_{50}$ of less than 200 pM for neutralization of RSV.

49. An antibody or antigen-binding polypeptide according to any preceding embodiment having an $IC_{50}$ of less than 100 pM for neutralization of RSV.

50. An antibody or antigen-binding polypeptide according to any preceding embodiment characterized by binding affinity to pre-F with a kD of less than 10 nM.

51. An antibody or antigen-binding polypeptide according to any preceding embodiment characterized by a binding affinity to pre-F that is at least 10, 100, or 1000 fold greater than binding affinity to post-F.

52. An antibody or antigen-binding polypeptide according to any preceding embodiment characterized by high affinity binding to RSV F site III.

53. A nucleic acid molecule encoding an antibody or antigen binding protein according to any preceding embodiment.

54. A vector comprising a nucleic acid molecule encoding an antibody or antigen binding protein according to any preceding embodiment.

55. A cell comprising a vector according to claim 54.

SEQUENCE LISTING (2331 sequences)

SEQ ID NO: 1 - protein, 124 aa, Artificial Sequence
  Description of Artificial Sequence: Synthetic heavy chain variable region amino acid sequence
EVQLVETGGGLVKPGGSLRLSCADSGFPFSSYSMHWVRQAPGKGLEWVASISSSSSFINYADSVKGRFTISRDNAKNSLYLQMNSLRAEDTAVYFCAREAACGGDCYGYYFDYWGQGTLVTVSS

SEQ ID NO: 2 - protein, 111 aa, Artificial Sequence
  Description of Artificial Sequence: Synthetic light chain variable region amino acid sequence
QSVVTQPPSASGAPGQRVTISCTGSSSNIGAGYDVHWYQQLPGTAPKVLISGNSNRPSGVPARFSGSKSGTSASLAITGLQAEDEADYYCQSYDSSLSGSVFGGGTQLTVL

SEQ ID NO: 3 - protein, 122 aa, Artificial Sequence
  Description of Artificial Sequence: Synthetic heavy chain variable region amino acid sequence
EVQLVESGGGLVKPGGSLRLSCAASGVTVSSYYMTWVRQAPGKGLEFISDISSSSTYTNYADSVKGRFTISRDNAKSSLYLQMNNLRAEDTAVYYCARLGITVTGVGYFDLWGRGTLVTVSS

SEQ ID NO: 4 - protein, 111 aa, Artificial Sequence
  Description of Artificial Sequence: Synthetic light chain variable region amino acid sequence
QPGLTQPPSVSGAPGQRVTISCTGSSSNIGAGYDVHWYQQLPGTAPKLLIHDNNNRPSGVPDRFSGSKSGTSASLAITGLQVEDEADYYCQSYDSSLSNYVFGTGTKLTVL

SEQ ID NO: 5 - protein, 128 aa, Artificial Sequence
  Description of Artificial Sequence: Synthetic heavy chain variable region amino acid sequence
EVQLVESGGGLVQPGRSLRLSCTASGFTFGDYAMSWVRQAPGKGLEWVGFIRSNAFGGTSEYAASVKGRFTISRDDSKSIAYLQMNSLKTEDTAVYYCTRDGIHDYGDSYYYYGMDVWGQGTTVTVSS

SEQ ID NO: 6 - protein, 106 aa, Artificial Sequence
  Description of Artificial Sequence: Synthetic light chain variable region amino acid sequence
DIQLTQSPSSLSASVGDRVTITCRASQTVTTYLNWYQQKPGKAPKLLIYGASSLQSGVPSRFSGSGSGTDFTLTINSLQPEDFATYYCQQTYSTVTFGPGTKVEIK

SEQ ID NO: 7 - protein, 121 aa, Artificial Sequence
  Description of Artificial Sequence: Synthetic heavy chain variable region amino acid sequence
EVQLLESGGEVKKPGASVKVSCKASGYTFTNYGISWVRQAPGQGLEWMGWISAYNGNTNYAQKLQGRVTMTTDTSTSTAYMEVRRLRSDDTAVYYCAREPPVIAAGDFQHWGQGTLVTVSS

SEQ ID NO: 8 - protein, 112 aa, Artificial Sequence
  Description of Artificial Sequence: Synthetic light chain variable region amino acid sequence
DIVMTQTPLSLPVTLGQPASISCRSSQSLVHSDTNIYLSWFQQRPGQSPRRLIYKVSNRDSGVPDRFSGSGSGTDFTLRISRVEAEDVGVYYCMQGTHWPPDFGQGTRLEIK

SEQ ID NO: 9 - protein, 123 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREYYDSSGYTNWFDPWGQGTLVTVSS

SEQ ID NO: 10 - protein, 110 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLAWVFGGGTQLTVL

SEQ ID NO: 11 - protein, 126 aa, Artificial Sequence
  Description of Artificial Sequence: Synthetic heavy chain variable region amino acid sequence
EVQLVESGGGVVQPGRPLRLSCAASGFTFSTYDLYWVRQAPGKGLDWVAIISPDGNKKYYADSVKGRFTISRDNSKNTLFLHMNSLRAEDTAVYYCARDYGNYFGSGSYYRYFDLWGRGTLVTVSS

SEQ ID NO: 12 - protein, 107 aa, Artificial Sequence
  Description of Artificial Sequence: Synthetic light chain variable region amino acid sequence
DIQLTQSPSSLSASVGDRVTITCRASQSISSHLNWYQQKPGKAPKLLIYASSSLQSGVPSRFSGSGSGTDFTLTISGLQPEDFATYYCQQSYSTPFTFGPGTKVEIK

SEQ ID NO: 13 - protein, 120 aa, Artificial Sequence
  Description of Artificial Sequence: Synthetic heavy chain variable region amino acid sequence
QVQLVESGGGVLQPGRSLRLPCEASGFTFNKYAMHWVRQAPGKGLEWVAAVSYDGGNKFYAESVKGRFTISRDNSKNTLYLQMNSLKPEDTAVYYCARDRWELLHGLDYWGLGTLVTVSS

SEQ ID NO: 14 - protein, 107 aa, Artificial Sequence
  Description of Artificial Sequence: Synthetic light chain variable region amino acid sequence
SYELTQPPSVSVSPGQTARITCSGEALAKQYAYWYQQKPGQAPVLVIYKDNERPSGISERFSGSSSGTTVTLTISGVQAEDEADYYCQSADSSGTYVFGTGTKVTVL

SEQ ID NO: 15 - protein, 123 aa, Artificial Sequence
  Description of Artificial Sequence: Synthetic heavy chain variable region amino acid sequence
EVQLVESGGGLVKPGGSLRLSCAASGFTLSSYTMNWVRQAPGRGLEWVSSIYSTSSYIYYADSVKGRFTISRDNAKNSLYLQMNSLRAEDTAVYYCARDSQAVTGTDLYFDSWGQGTLVTVSS

SEQ ID NO: 16 - protein, 108 aa, Artificial Sequence
  Description of Artificial Sequence: Synthetic light chain variable region amino acid sequence
QPGLTQPPSVSVAPGKTARITCGGNNIGRKNVHWYQQKPGQAPILVIYYDSDRPSGIPERFSGSNSGNTATLTISRVEDGDEADYYCQVWDSSNDHVIFGGGTQLTVL

SEQ ID NO: 17 - protein, 120 aa, Artificial Sequence
  Description of Artificial Sequence: Synthetic heavy chain variable region amino acid sequence
QVQLVQSGGGLVQPGGSLRLSCAGSGFTFSDYEMNWVRQAPGKGLEWLSYISSSGSIIYYADSVKGRFTISRDNAKNSLYLQMNSLRAEDTGLYYCARANHRHYYGMDVWGQGTTVTVSS

SEQ ID NO: 18 - protein, 107 aa, Artificial Sequence
  Description of Artificial Sequence: Synthetic light chain variable region amino acid sequence
DIRLTQSPSTLSASVGDRVTITCRASQSIGSWLAWYQQKPGKAPKLLIYKASSLESGVPSRFSGSGSGTEFTLTISSLQPDDFATYYCQQYNSYSYTFGRGTRLEIK

SEQ ID NO: 19 - protein, 126 aa, Artificial Sequence
  Description of Artificial Sequence: Synthetic heavy chain variable region amino acid sequence
QVTLKESGPVLVKPTETLTLTCTVSGFSLSNAKMGVSWIRQPPGKALEWLAYISSNDEKSYSTSLKSRLTISKDTSKSQVVLTMTNMDPVDTATYYCARILLYDSSGYYLWYFDLWGRGTLVTVSS

SEQ ID NO: 20 - protein, 107 aa, Artificial Sequence
  Description of Artificial Sequence: Synthetic light chain variable region amino acid sequence
DIQVTQSPSSLSASVGDRVTITCRASQRITSYLNWYQHKPGKAPKLLIFAASSLHSGVPSTFSGSGSGTDFTLTISSLQPEDFATYYCQQSYSTPWTFGQGTKVEIK

SEQ ID NO: 21 - protein, 121 aa, Artificial Sequence
  Description of Artificial Sequence: Synthetic heavy chain variable region amino acid sequence
QVQLVQSGAEVKKPGSSVKVSCKASGGTFSSYGVNWVRQAPGQGLEWMGRIIPMFGTSNYAQKFQGRVTITADGSTSTAYMELSSLRSEDTAVYYCARVGSPTTGAIMGVWGQGTTVTVSS

SEQ ID NO: 22 - protein, 112 aa, Artificial Sequence
  Description of Artificial Sequence: Synthetic light chain variable region amino acid sequence
DIVLTQTPLSLPVTPGEPASISCRSSQSLLQSNGFNYLDWYLQKPGQSPKLLIYMGSNRASGVPDRFSGSGSGTDFTLIISRVEAEDVGVYYCMQAIESPLTFGGGTKVDIK

SEQ ID NO: 23 - protein, 124 aa, Artificial Sequence
  Description of Artificial Sequence: Synthetic heavy chain variable region amino acid sequence
QVQLVQSGGGLVQPGGSLRLSCAASGFTFRTYALSWVRQAPGKGLEWVSSILGSGGSTYYADSVKGRFTISRDNSKNTLYLQLNSLRAEDTAVYFCAKLAVAGLLHHYYGLDVWGQGTTVTVSS

SEQ ID NO: 24 - protein, 108 aa, Artificial Sequence
  Description of Artificial Sequence: Synthetic light chain variable region amino acid sequence
SYELTQPPSVSVSPGQTASITCSGDKLENKYACWYQQKPGQSPVLLIYQDTKRPSGIPERFSGSNSGTTATLTISGTQALDEADYYCQAWDSSTASVLFGGGTQLTVL

SEQ ID NO: 25 - protein, 118 aa, Artificial Sequence
  Description of Artificial Sequence: Synthetic heavy chain variable region amino acid sequence
QITLKESGAEVKKPGASVKVSCKVSGYTLSDFSMHWVRQAPGKGLEWMGSFDPEDGETVDAQKFQGRVTMTEDRSTATAYMELRSLRSEDTAVYYCGTPASAGQVDYWGQGTLVTVSS

SEQ ID NO: 26 - protein, 107 aa, Artificial Sequence
  Description of Artificial Sequence: Synthetic light chain variable region amino acid sequence
DIVLTQSPSSLSASVGDRVTITCRASQSISSYLHWYQQKPGKAPKLLIYAASSLQSGVPSRFSGSGSGTDFTLTISSLQPEDFATYYCQQSYITPYTFGQGTKLEIK

SEQ ID NO: 27 - protein, 124 aa, Artificial Sequence
  Description of Artificial Sequence: Synthetic heavy chain variable region amino acid sequence
EVQLLESGGGLVKPGGSLRLSCAASGFRFSSYSMNWVRQAPGKWLEWVSSISASSSYTDYADSVKGRFTISRDNAKNSLYLQMNSLRAEDTAVYYCAREDYLSSGSLLHWFDPWGQGTLVTVSS

SEQ ID NO: 28 - protein, 110 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNNNRPSGVPDRFSGSKSGTSASLAITGLQAEDEADYYCQSYDSRLSVLFGGGTKVTVL

SEQ ID NO: 29 - protein, 122 aa, Artificial Sequence
  Description of Artificial Sequence: Synthetic heavy chain variable region amino acid sequence
EVQLVESGGGLVKPGGSLRLSCAASGFTFRDYYMNWIRQAPGKGLEWVSDISASSSYTNYADSVKGRFTISRDNAKTSLYLQMNSLRAEDTAVYYCAREVVTAMGGYYFDYWGQGTLVTVSS

SEQ ID NO: 30 - protein, 112 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNNNRPSGVPDRFSGSKSGTSASLAITGLQAEDEADYYCQSYDSSLSGSGVFGTGTKVTVL

SEQ ID NO: 31 - protein, 120 aa, Artificial Sequence
  Description of Artificial Sequence: Synthetic heavy chain variable region amino acid sequence
QVQLVESGGGVAQPGGSLRLSCVASGFTFSNYGMHWVRQAPGKGLEWVAFIRSDGSKKYYGDSGKGRFTISRDNSKNTLYLQMNSLRAEDTALYYCARERAGATFAFDIWGQGTTVTVSS

SEQ ID NO: 32 - protein, 111 aa, Artificial Sequence
  Description of Artificial Sequence: Synthetic light chain variable region amino acid sequence
QSALTQPRSVSGSPGQSVTISCTGTSSDVGGYNFVSWYQHHPGKAPKLMIYDVTNRPSGVPDRFSGSKSGNTASLTISGLQADDEADYYCCSYAGGFTFYVFGTGTKVTVL

SEQ ID NO: 33 - protein, 121 aa, Artificial Sequence
  Description of Artificial Sequence: Synthetic heavy chain variable region amino acid sequence
EVQLVESGAEVKKPGSSVKVSCKASGGTLSSYAFSWVRQAPGQGLEWMGGVIPISATSDYAQKFQGRVTITADESTSTVYMELRSLRSEDTAVYYCARDTRYSSGWFYDYWGQGTLVTVSS

SEQ ID NO: 34 - protein, 113 aa, Artificial Sequence
  Description of Artificial Sequence: Synthetic light chain variable region amino acid sequence
DIRLTQSPDSLAVSLGERATINCKSSQSVLYSSNNKNYLAWYQQKPGQPPNLLIYWASTRDSGVPDRFSGSGSGTDFTLTISRLQAEDVAVYYCQQYYSTPYTFGQGTKLEIK

SEQ ID NO: 35 - protein, 131 aa, Artificial Sequence
  Description of Artificial Sequence: Synthetic heavy chain variable region amino acid sequence
EVQLVESGPGLVKPSETLSLTCTVSGDSVSNNNYYWNWIRQSPGKGLEWIGYIYYSGSTDYNPSLKSRVTISVDTSKNQFSLNLRSVTAADTAIYFCASAPWGMFTILGVVPSYYYGMDVWGQGTTVTVSS

SEQ ID NO: 36 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGSSNRPSGVPDRFSGSRSGTSASLAITGLQAEDEADYYCQSYDGSLGVYVFATGTKVTVL

SEQ ID NO: 37 - protein, 122 aa, Artificial Sequence
  Description of Artificial Sequence: Synthetic heavy chain variable region amino acid sequence
EVQLLESGGGLVQPGGSLRLSCSASGFTFSTYWMHWVRQAPGKGLVWVSRINGDGNDRNYADSVKGRFTISRDNAKNTVYLQMNSLRAEDTAVYYCARGGATGDFYFGMDVWGQGTTVTVSS

SEQ ID NO: 38 - protein, 110 aa, Artificial Sequence
  Description of Artificial Sequence: Synthetic light chain variable region amino acid sequence
SYELTQPPSVSVAPGKTAKITCGGNNIGTKSVHWYQQKPGQAPVLVIYYDTDRPSGIPERFSGSNSGNTATLTISRVEAGDEADYYCQVWDSSNSDHVGVFGGGTQLTVL

SEQ ID NO: 39 - protein, 123 aa, Artificial Sequence
  Description of Artificial Sequence: Synthetic heavy chain variable region amino acid sequence
EVQLLETGPGLVKPSQTLSLICAVSGGSISSGGYSWSWIRQPPGKGLEWVGYISYSGSTYYNPSLKSRVTISVDTSKNQFSLKLNSVTAADTAVYFCARVDGIYSSGMRFDYWGQGTLVTVSS

SEQ ID NO: 40 - protein, 107 aa, Artificial Sequence
  Description of Artificial Sequence: Synthetic light chain variable region amino acid sequence
DIQLTQSPGTLSLSPGERATLSCRASQSVSSYYLAWYQQKPGQAPRLLIYGTSSRATGIPDRFSGSGSGTDFTLTISRLEPEDFAVYYCQQYGRSPLFGQGTRLEIK

SEQ ID NO: 41 - protein, 119 aa, Artificial Sequence
  Description of Artificial Sequence: Synthetic heavy chain variable region amino acid sequence
QVQLVQSGAEVKKPGSSVKVSCKASGGTFSSYTISWVRQAPGQGLEWMGRIKPIIGIANNAQRFKGRVTITAEKSTGTAYMELSSLTSEDTAVYYCARGGYDYYGMDVWGQGTTVTVSS

SEQ ID NO: 42 - protein, 111 aa, Artificial Sequence
  Description of Artificial Sequence: Synthetic light chain variable region amino acid sequence
QSALTQPASVSGSPGQSITISCTGTSSDVGGYNYVSWHQQHPGKAPKLLIYDVSNRPSGVSNRFSGSKSGNTASLSISGLQAEDEADYYCSSFTSTSTPYVFGTGTQLTVL

SEQ ID NO: 43 - protein, 123 aa, Artificial Sequence
  Description of Artificial Sequence: Synthetic heavy chain variable region amino acid sequence
QVQLVQSGAEVKKPGSSAKVSCKASGGTFSSYTISWVRQAPGQGLEWMGRIIPFLGIANYAQKFQGRVTFTADKSTSTVYMDLSRLRSEDTALYYCAREPMYYGGDSYAFDVWGQGTTVTVSS

SEQ ID NO: 44 - protein, 110 aa, Artificial Sequence
  Description of Artificial Sequence: Synthetic light chain variable region amino acid sequence
QSVLTQPASMSGSPGHSITISCTGTSSDVGAYNYVSWYQQHPGKAPKLMIYDVSNRPSGVSSRFSGSKSGNTASLTISGLQPEDEADYYCSSFTTSSTRVFGTGTKLTVL

SEQ ID NO: 45 - protein, 122 aa, Artificial Sequence
  Description of Artificial Sequence: Synthetic heavy chain variable region amino acid sequence
EVQLVESGPTLVKPTQTLTLTCTFSGFSLSTSGVGVGWIRQPPGKALEWLAVIYWDDDKTYSPSLKSRLTITKDTSKNQVVLTMTNMNPVDTATYYCARCPAPVYSYGVDVWGQGTTVTVSS

SEQ ID NO: 46 - protein, 111 aa, Artificial Sequence
  Description of Artificial Sequence: Synthetic light chain variable region amino acid sequence
QSALTQPASVSGSPGQSITISCTATSSDFGGYDYVSWYQQHPGEAPKLMISDVTNRPSGVSNRFSGSKSGNTASLTISGLQAEDEADYYCSSYTSYTTPYVFGTGTKLTVL

SEQ ID NO: 47 - protein, 130 aa, Artificial Sequence
  Description of Artificial Sequence: Synthetic heavy chain variable region amino acid sequence
QVQLQESGAGLLKPSETLSLTCAVYGGSFSGYYWSWIRQPPGKGLEWIGEINHSGSTNYNPSLKSRVTISVDTSKNQFSLKLSSVTAADTAVYYCARDQRIVVVGAATEPYYYYYGMDVWGQGTTVTVSS

SEQ ID NO: 48 - protein, 108 aa, Artificial Sequence
  Description of Artificial Sequence: Synthetic light chain variable region amino acid sequence
QPVLTQPPSVSVSPGQTARITCSGDALPKQYAYWYQQKPGQAPVLVIYKDSERPSGIPERFSGSSSGTTVTLTISGVQAEDEADYYCQSADSSGTYRVFGGGTKLTVL

SEQ ID NO: 49 - protein, 129 aa, Artificial Sequence
  Description of Artificial Sequence: Synthetic heavy chain variable region amino acid sequence
EVQLVESGGGVVQPGRSLRLSCAASGFTFSNYAMHWVRQAPGKGLEWVSIISYDGSNKYYADSVKGRFTISRDNSKNTLYLQINSLRTEDTAVYYCARARKRIPIVVVTAPYYYGMDVWGQGTTVTVSS

SEQ ID NO: 50 - protein, 107 aa, Artificial Sequence
  Description of Artificial Sequence: Synthetic light chain variable region amino acid sequence
DIRVTQSPSSLSASVGDRVTITCRASQSISSYLHWYQQQPGKAPNLLIYAASNLQSGVPSRFSGSGSGTDFTLTISSLQPEDFATYYCQQSYTTPHTFGQGTKVEIK

SEQ ID NO: 51 - protein, 118 aa, Artificial Sequence
  Description of Artificial Sequence: Synthetic heavy chain variable region amino acid sequence
QVQLVQSGGGLVKPGGSLRLSCVASGFTFSDYYMTWIRQAPGKGLEWVSYISGSSAYTIYADSVKGRFTISRDNAKNSLYLQMNGLRAEDTAVYYCARVSWVRSLDSWGQGTLVTVSS

SEQ ID NO: 52 - protein, 110 aa, Artificial Sequence
  Description of Artificial Sequence: Synthetic light chain variable region amino acid sequence
QSALTQPASVSGSPGQSITISCTGSTSDVGLYNYVSWYQLHPGKAPKLIIYDVRHRPSGVSDRFSASKSGNTASLTISGLQAEDEADYYCCSYTSSSTYVFGSGTQLTVL

SEQ ID NO: 53 - protein, 126 aa, Artificial Sequence
  Description of Artificial Sequence: Synthetic heavy chain variable region amino acid sequence
QVQLVQSGPALVKPTQTLTLTCTFSGFSLSTSGMCVSWIRQPPGKALEWLARIDWDDDKYYSTSLKTRLTISKDTSKNQVVLTMTNMDPVDTATYYCARATNYDSSGYYSLYFDYWGQGTLVTVSS

SEQ ID NO: 54 - protein, 107 aa, Artificial Sequence
  Description of Artificial Sequence: Synthetic light chain variable region amino acid sequence
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 55 - protein, 123 aa, Artificial Sequence
  Description of Artificial Sequence: Synthetic heavy chain variable region amino acid sequence
QVQLVQSGAEVKKPGASVKVSCKASGYTFTTYSMHWVRQAPGQRLEWMGWINAGNGNTKYSQKFQGRVTITRDTSASTAYMELSSLRSEDTAVYYCARDGVGGAYYYGEMDVWGQGTTVTVSS

SEQ ID NO: 56 - protein, 113 aa, Artificial Sequence
  Description of Artificial Sequence: Synthetic light chain variable region amino acid sequence
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRFTFGPGTKVEIK

SEQ ID NO: 57 - protein, 120 aa, Artificial Sequence
  Description of Artificial Sequence: Synthetic heavy chain variable region amino acid sequence
EVQLLESGGGFVQPGGSLRLSCAASGFTFSSYAVNWVRQAPGKGLEWVSLISGSGRTDYTDSVKGRFTISRDNAKNTLFLQMNSLRVEDTAVYYCAKSWGSSGYGYLDYWGQGTLVTVSS

SEQ ID NO: 58 - protein, 111 aa, Artificial Sequence
  Description of Artificial Sequence: Synthetic light chain variable region amino acid sequence
QSGLTQPPSVSGAPGQRVTISCTGSSSNIGPGTDVHWYQHFPGTAPKLLIFGNSNRPSGVPDRFSGSKSGTSASLAITGLQAEDEAYYYCQSYDRTLSASVFGGGTKLTVL

SEQ ID NO: 59 - protein, 122 aa, Artificial Sequence
  Description of Artificial Sequence: Synthetic heavy chain variable region amino acid sequence
EVQLLESGGGLVQPGGSLRLSCAASGFTFSSYAMSWVRQAPGKGLEWVSGISGSGGSTYYADSVKGRFTISRDNSKNTLYLEMNSLRAEDTAVYYCAKRYYYGSGTYTFDIWGQGTMVTVSS

SEQ ID NO: 60 - protein, 107 aa, Artificial Sequence
  Description of Artificial Sequence: Synthetic light chain variable region amino acid sequence
DIRLTQSPSSLSASVGDRVTITCRASQSIISYLNWYQQKPGKAPKLLIYAASSLQSGVPSRFSGSGSGTDFTLTISSLQPEDFATYYCQQSYSTPYTFGQGTKVEIK

SEQ ID NO: 61 - protein, 124 aa, Artificial Sequence
  Description of Artificial Sequence: Synthetic heavy chain variable region amino acid sequence
QVQLVESGGGLVKPGGSLRLSCAASGFTFSDYYMSWIRQAPGKGLEWVSYISGGGTYTKYADSVKGRFTISRDNAKNSVYLQMNSLRAEDTAVYYCARDVALVGWELRYGMDVWGQGTTVTVSS

SEQ ID NO: 62 - protein, 108 aa, Artificial Sequence
  Description of Artificial Sequence: Synthetic light chain variable region amino acid sequence
ETTLTQSPGTLSLSPGERATLSCRARENVNSSYLAWYQQKPGQAPRLLIYGASSRATGIPDRFSGSGSGTDFTLTISRLEPEDFAVYYCQQYAISPWTFGQGTKVEIK

SEQ ID NO: 63 - protein, 127 aa, Artificial Sequence
  Description of Artificial Sequence: Synthetic heavy chain variable region amino acid sequence
QVQLVQSGAEVKKPGESLKISCKGSGYSFTSHWIGWVRQMPGKGLEWMGITDPGDSDTRYSPSFQGQVTISADKSISTAYLQWSSLKASDTAMYYCAREPRRWMTTETNGPYYFDNWGQGTLVTVSS

SEQ ID NO: 64 - protein, 108 aa, Artificial Sequence
  Description of Artificial Sequence: Synthetic light chain variable region amino acid sequence
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDNRVFGGGTKVTVL

SEQ ID NO: 65 - protein, 118 aa, Artificial Sequence
  Description of Artificial Sequence: Synthetic heavy chain variable region amino acid sequence
QVQLVQSGAEVKKPGASVKVSCKVSGYTLTKLSMHWVRQAPGKGLEWMGFFDPEDGDTLYAQKFQGRVTMTEDTSSDTPYMELRSLRSEDTAVYYCASPAAAGQFDYWGQGTLVTVSS

SEQ ID NO: 66 - protein, 107 aa, Artificial Sequence
  Description of Artificial Sequence: Synthetic light chain variable region amino acid sequence
DIVMTQSPSSLSASVGDRVTITCRASQFISSYLHWYQQKTGKAPKLLIYAASSLQSGVPSRFSGSGSGTDFTLTISSLQPEDFATYYCQQSYNTPRTFGQGTKLEIK

SEQ ID NO: 67 - protein, 123 aa, Artificial Sequence
  Description of Artificial Sequence: Synthetic heavy chain variable region amino acid sequence
QVQLVQSGTEVKKPGASVKVSCKASGYTFNMYGVSWVRQAPGQGLEWMGWISAYNGNTNYAQKFQGRVTMTIDTSTTTAYMELRSLRSDDTAMYYCARDFQAEEPLSNWFDPWGQGTLVTVSS

SEQ ID NO: 68 - protein, 107 aa, Artificial Sequence
  Description of Artificial Sequence: Synthetic light chain variable region amino acid sequence
DIVMTQTPSSLSASVGDRVIITCRASQSISRYINWYQKKPGKAPKFLIYAVSSLGSGVPSRFSGSGSGTDFTLTISSLQPEDFATYYCQQSYSTPFTFGPGTKVDIK

SEQ ID NO: 69 - protein, 125 aa, Artificial Sequence
  Description of Artificial Sequence: Synthetic heavy chain variable region amino acid sequence
EVQLLESGGGLVQPGGSLRLSCAASGFTFGSYDMNWVRQAPGKGLEWVSGISGSGDATYYADSVKGRFTISRDNSKNMLYLQMNSLSAEDMAVYYCARDRAFTMKYNSNWYKIYWGQGTMVTVSS

SEQ ID NO: 70 - protein, 108 aa, Artificial Sequence
  Description of Artificial Sequence: Synthetic light chain variable region amino acid sequence
EIVLTQSPGTLSLSPGERATLSCRASQSVTSSYLAWYQQKPGQAPRLLIYGAFSRATGIPDRFSGSGSGTDFTLTISRLEPEDFAVYYCHHYGTSRWTFGQGTKVDIK

SEQ ID NO: 71 - protein, 127 aa, Artificial Sequence
  Description of Artificial Sequence: Synthetic heavy chain variable region amino acid sequence
EVQLVESGGGLVKPGGSLRLSCAASGFTFINAWMSWVRQAPGKGLEWVGRIKSKADGGTTDDAAPVKGRFTISRDDSKNTLYLQMNSLKIEDTAVYYCATDVLPLYNWNLGWNFDLWGRGTLVTVSS

SEQ ID NO: 72 - protein, 108 aa, Artificial Sequence
  Description of Artificial Sequence: Synthetic light chain variable region amino acid sequence
SYVLTQPPSVSVAPGKTARITCGGNNIADKSVHWYQQKPGQAPVLVMYYDTDRPSGIPERFSGFNSGNTATLTISRVEAGDEADYYCQVWDSSSDHVVFGGGTKVTVL

SEQ ID NO: 73 - protein, 131 aa, Artificial Sequence
  Description of Artificial Sequence: Synthetic heavy chain variable region amino acid sequence
QVQLVQSGAEVKKPGSSVKVSCKASGGTFSSNAISWVRQAPGQGLEWMGGIIPIFATANYAQNFQDRVTITADESTGTAYMELSSLRYEDTAVYYCAKSAIHSGYHGPARSGFYQNGMDVWGQGTTVTVSS

SEQ ID NO: 74 - protein, 110 aa, Artificial Sequence
  Description of Artificial Sequence: Synthetic light chain variable region amino acid sequence
SYELTQPPSASGTPGQRVTISCSGSSSNIGINPVNWYQHFPGTAPKLLIYRNNQRPSGVPDRFSGSKSGTSASLAISGLQSEDEAVYYCAAWDDRLNGPVFGGGTQLTVL

SEQ ID NO: 75 - protein, 123 aa, Artificial Sequence
  Description of Artificial Sequence: Synthetic heavy chain variable region amino acid sequence
EVQLVESGGGVVQPGKSLRLSCAASGFSFSTFAMHWVRQAPGKGLEWVAVISYDGSNKFYADSVKGRFTISRDSSKNTLYLQMNSLRAEDTAVYYCARGGYSSGWYVTHFDYWGQGTLVTVSS

SEQ ID NO: 76 - protein, 111 aa, Artificial Sequence
  Description of Artificial Sequence: Synthetic light chain variable region amino acid sequence
QSVLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNLYVFGTGTKLTVL

SEQ ID NO: 77 - protein, 122 aa, Artificial Sequence
  Description of Artificial Sequence: Synthetic heavy chain variable region amino acid sequence
EVQLVESGGGLVQPGGSLRLSCAASGFTFSNYAMTWVRQAPGKGLEWLSSISGSGGSTYYADSVKGRFTISRDNSRNTLYVQMNSLRVEDTAFYYCAKAFYEYGAGSPGDYWGQGTLVTVSS

SEQ ID NO: 78 - protein, 108 aa, Artificial Sequence
  Description of Artificial Sequence: Synthetic light chain variable region amino acid sequence
DIQLTQSPSSLSASVGDRVTITCRASQSIGTNLNWYQQKPGKAPKFLIYAASSLQRGVPSRFSGSGSGSEFTLTISSLQPEDFATYYCQQSYSTLPITFGQGTKLEIK

SEQ ID NO: 79 - protein, 121 aa, Artificial Sequence
  Description of Artificial Sequence: Synthetic heavy chain variable region amino acid sequence
QVQLLESGGGLVQPGGSLRLSCAASGFTFSNYAMGWVRQAPGQGLEWVSRISATGGSTHYADSVRGRFTISRDNSKNTLYLQMNSLKAEDTAVYYCAKDRGYSRNLTPDYWGQGTLVTVSS

SEQ ID NO: 80 - protein, 107 aa, Artificial Sequence
  Description of Artificial Sequence: Synthetic light chain variable region amino acid sequence
ETTLTQSPSSLSASVGDRVTITCRASQGITNDLGWYQKKPGKAPKLLIYVASSLQSGVPSRFSGSGSGTDFTLTISSLQPEDFATYYCLQDYNYPITFGQGTKVDIK

SEQ ID NO: 81 - protein, 126 aa, Artificial Sequence
  Description of Artificial Sequence: Synthetic heavy chain variable region amino acid sequence
QVQLQQWGAGLLKPSETLSLTCAVYGGSFSGSYWSWIRQPPGKGLEWIGEINHSGSTSYNPSLKSRVTISVDTSKKQFSLKLSSMTAADTAVYYCAGGFYYDSSGSYAPHPTFDYWGQGTLVTVSS

SEQ ID NO: 82 - protein, 107 aa, Artificial Sequence
  Description of Artificial Sequence: Synthetic light chain variable region amino acid sequence
DIVMTQTPATLSVSPGERATLSCRASQSVSSNLAWYQQKPGQAPRLLIYGASTRATGIPARFSGSGSGTEFTLTISSLQSEDFAVYYCQQYNNWPRTFGQGTKVEIK

SEQ ID NO: 83 - protein, 122 aa, Artificial Sequence
  Description of Artificial Sequence: Synthetic heavy chain variable region amino acid sequence
QVQLVQSGGVVVQPGGSLRLSCAASGFNFDDFTMHWVRQAPGKGLEWVSLITWDGGITYYADSVKGRFTISRDNGKNSLYLRMNSLRTEDTALYYCAKDGDRYSGYAFLDYWGQGTLVTVSS

SEQ ID NO: 84 - protein, 108 aa, Artificial Sequence
  Description of Artificial Sequence: Synthetic light chain variable region amino acid sequence
SYELTQPPSVSVAPGKTARLTCGGNNIGSESVHWYQQRPGQAPVLVSYYNGDRPSGIAERISASKSGNTATLTIYRVEAGDEADYYCQVWHSSSDHFVFGTGTQLTVL

SEQ ID NO: 85 - protein, 122 aa, Artificial Sequence
  Description of Artificial Sequence: Synthetic heavy chain variable region amino acid sequence
EVQLVESGGGLVQPGGSLRLSCAVSGFTFSNYAVSWVRQAPGKGLEWVSGISGSGGTTYYVDSVKGRFTVSRDNSKNTLFLQLNSLKAEDTAVYYCAKDWGYSGGRPYFDYWGQGTLVTVSS

SEQ ID NO: 86 - protein, 110 aa, Artificial Sequence
  Description of Artificial Sequence: Synthetic light chain variable region amino acid sequence
QSVLTQPPSVSGAPGQRVTISCTASSSNIGPIYDVHWYQQLPGTGPKLLIYGNNNRPSGVPDRFSGSKSGTSASLAITGLQAEDEADYYCQSYDTSLSVVFGGGTKLTVL

SEQ ID NO: 87 - protein, 120 aa, Artificial Sequence
  Description of Artificial Sequence: Synthetic heavy chain variable region amino acid sequence
EVQLVESGGGLVQPGGSLRLSCAASGFTFSSYWMHWVRQAPGKGPVWVSRINSDGSTTNYADYMKGRFTISRDNAKNTVYLQMNSLRAEDTAVYYCARDSDSYDDAFDIWGQGTTVTVSS

SEQ ID NO: 88 - protein, 108 aa, Artificial Sequence
  Description of Artificial Sequence: Synthetic light chain variable region amino acid sequence
SYELTQPPSVSVSPGQTARISCSGEALPKKYSYWYQQKSGQAPVLVIYEDSKRPSGIPERFSGSSSGTMATLTISGAQVEDEADYYCYSTDSSGNHRVFGGGTKVTVL

SEQ ID NO: 89 - protein, 122 aa, Artificial Sequence
  Description of Artificial Sequence: Synthetic heavy chain variable region amino acid sequence
EVQLVESGGGVVQPGGSLRLSCAVSGITFSSYGMHWVRQAPGKGLEWVAFIRYDGSNKYYGDSLRGRFTISRDNSKNTLYLQMNSLRAEDTAVYYCAKDAVGIGGYYGLDVWGQGTTVTVSS

SEQ ID NO: 90 - protein, 107 aa, Artificial Sequence
  Description of Artificial Sequence: Synthetic light chain variable region amino acid sequence
DIQMTQSPSSLSASVGDRVTITCRASQGIRNDLGWYQQKPGKAPKRLIYAASSLQSGVPSRFSGSGSGTEFTLTISSLQPEDFATYYCLQHNGYPWTFGQGTKVEIK

SEQ ID NO: 91 - protein, 122 aa, Artificial Sequence
  Description of Artificial Sequence: Synthetic heavy chain variable region amino acid sequence
QVQLVESGGGLVQPGGSLRLSCAASGFTFSSYWMHWVRQAPGKGLVWVSRINSDGSSPTYADSVKGRFTISRDNAKNTVFLQMNSLRAEDTAVYYCARESWELIRGDAFDIWGQGTTVTVSS

SEQ ID NO: 92 - protein, 107 aa, Artificial Sequence
  Description of Artificial Sequence: Synthetic light chain variable region amino acid sequence
DIQMTQSPSSLSASVGDRVTITCRASQSISSSLNWYQQKPGKAPNLLIYAASTLQSGVPSRFSGSGSGTDFTLTISSLQPEDFATYYCQQSYRTPRTFGQGTKVEIK

SEQ ID NO: 93 - protein, 126 aa, Artificial Sequence
  Description of Artificial Sequence: Synthetic heavy chain variable region amino acid sequence
EVQLLESGGGVVQPGRSLRLSCAASGFTFSSYAMHWVRQAPGKGLEWVAVIGNDGTNKYHADSVKGRFTISRDNSKNTLYLQMNSLRAEDTAVYYCARRRVGIMYSGSYWGGMDVWGQGTTVTVSS

SEQ ID NO: 94 - protein, 108 aa, Artificial Sequence
  Description of Artificial Sequence: Synthetic light chain variable region amino acid sequence
SYELTQPPSVSVSPGQTASITCSGDKLGGKYVSWYQQKPGQSPVLVMYQDTRRPSGIPERLSGSNSGSTATLTISATQAMDEADYYCQAWDITTVHVVFGGGTKLTVL

SEQ ID NO: 95 - protein, 121 aa, Artificial Sequence
  Description of Artificial Sequence: Synthetic heavy chain variable region amino acid sequence
QVQLVQSGAEVKKPGESLKISCKGSGYTFTSYWIGWVRQLPGKGLEWMGVIFPGDSDTRYSPSFQGQVTISADKSISTAYLQWSSLKAADTAMYYCARTRLGRGFYRFDSWGQGTLVTVSS

SEQ ID NO: 96 - protein, 111 aa, Artificial Sequence
  Description of Artificial Sequence: Synthetic light chain variable region amino acid sequence
QSVLTQPPSVSAAPGQKVTISCSGSSSNIGNNYVSWYQQLPGTAPRLLIYENNERPSGIPDRFSGSKSGTSATLGITGLQTGDEADYYCATWDSGLSAGYVFGTGTKLTVL

SEQ ID NO: 97 - protein, 129 aa, Artificial Sequence
  Description of Artificial Sequence: Synthetic heavy chain variable region amino acid sequence
EVQLVESGGGLVQPGGSLRLSCAASGFTFSSYSMNWVRQAPGKGLEWVSYIGSSSSSVYYGDSAKGRFTISRDNAKNSLYLQMNSLRDEDTALYYCARVGWLQYCRGGSCYASFGMDVWGQGTTVTVSS

SEQ ID NO: 98 - protein, 107 aa, Artificial Sequence
  Description of Artificial Sequence: Synthetic light chain variable region amino acid sequence
DIQMTQSPSSLSASVGDRVTITCRASQGIRNDLGWYQQKPGIAPKLLIYAASSLQSGVPSRFSGSGSGTDFTLTISSLQPEDFATYYCLQDYDSPYTFGQGTKLEIK

SEQ ID NO: 99 - protein, 119 aa, Artificial Sequence
  Description of Artificial Sequence: Synthetic heavy chain variable region amino acid sequence
EVQLLESGGGVVQPGRSLRLSCAASGFTFSAYGFHWVRQAPGKGLEWVAVIWFDGNNKYYADSMKGRFIISRDNSKNTLYLQMNSLRAEDTAVYYCARDPKETGEFDYWGQGTLVTVSS

SEQ ID NO: 100 - protein, 110 aa, Artificial Sequence
  Description of Artificial Sequence: Synthetic light chain variable region amino acid sequence
QSALTQPASVSGSPGQSITISCTGTISDVGRYNYVSWYQQHPGKAPKLMIYDVTNRPSGVSNRFSGSKSGNTASLTISGLQAEDEAVYYCCSYTISSTYVFGTGTKLTVL

SEQ ID NO: 101 - protein, 127 aa, Artificial Sequence
  Description of Artificial Sequence: Synthetic heavy chain variable region amino acid sequence
QITLKESGPTLVKPTQTLTLTCTFSGFSLSTSGVGVGWIRQPPGKALEWLALIYWDEDKRYSPSLKTRLTITKDTSRNQVKLTMTNMDPVDTATYYCAHQYYDILTGYPSPGAFDIWGQGTTVTVSS

SEQ ID NO: 102 - protein, 109 aa, Artificial Sequence
  Description of Artificial Sequence: Synthetic light chain variable region amino acid sequence
QPVLTQPASVSGSPGQSITISCTGTSSDVVSYNLVSWFQQHPGKAPKLMIYEVTRRPSGVSNRFSGSKSGNTASLTISGLQAEDEADYYCCAYTGTPVVFGGGTKLTVL

SEQ ID NO: 103 - protein, 121 aa, Artificial Sequence
  Description of Artificial Sequence: Synthetic heavy chain variable region amino acid sequence
QVQLQESGSGLVKPSQTLSLTCTVSGGSISSVGYSWSWIRQPPGKGLEWIGYIYHSGSPYYSPSLNSRVTISVDRSKNQFSLKLSSVTAADTAVYFCARVFFGGGGAFDIWGQGTTVTVSS

SEQ ID NO: 104 - protein, 109 aa, Artificial Sequence
  Description of Artificial Sequence: Synthetic light chain variable region amino acid sequence
QPGLTQPPSVSVAPGQTARITCGGNNIGSKSVQWYQQKPGQAPVLVMYYDSDRPSGIPDRFSGSSSGNTATLTITRVEAGDEADYSCQVWDSVNVHPVIFGGGTKLTVL

SEQ ID NO: 105 - protein, 118 aa, Artificial Sequence
  Description of Artificial Sequence: Synthetic heavy chain variable region amino acid sequence
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCASSSYSNYFDYWGQGTLVTVSS

SEQ ID NO: 106 - protein, 111 aa, Artificial Sequence
  Description of Artificial Sequence: Synthetic light chain variable region amino acid sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNPWVFGGGTKLTVL

SEQ ID NO: 107 - protein, 125 aa, Artificial Sequence
  Description of Artificial Sequence: Synthetic heavy chain variable region amino acid sequence
EVQLVESGGGLVQPGGSLRLSCAASRFTFSSYAMSWVRQAPGKGLEWVSGIGASGGTTYYADSVKGRFTISRDNSKNTVYLQMNSLRAEDTAVYYCARCEYYYGSGSAGYYFDYWGQGTLVTVSS

SEQ ID NO: 108 - protein, 106 aa, Artificial Sequence
  Description of Artificial Sequence: Synthetic light chain variable region amino acid sequence
SYELTQPPSVSVSPGQTASITCSGDKLGSKFAFWYQQKPGQSPVLVIFQDVKRPSGIPERFSGSNSGNTATLTISGTQAMDEADYYCQAWDSGTAVFGGGTKVTVL

SEQ ID NO: 109 - protein, 118 aa, Artificial Sequence
  Description of Artificial Sequence: Synthetic heavy chain variable region amino acid sequence
EVQLVESGGGVVQPGRSLRLSCAASGFTFSSYPMHWVRQAPGKGLEWVAVISYDGSNKYYADSVKGRFTISRDNSKNTLYLQMNSLRAEDTAVYSCARAQSAAIFDHWGQGTLVTVSS

SEQ ID NO: 110 - protein, 110 aa, Artificial Sequence
  Description of Artificial Sequence: Synthetic light chain variable region amino acid sequence
QAVVTQEPSLTVSPGGTVTLTCASSTGAVTSGYYPNWFQQKPGQAPRALIYTTSKRHSWTPARFSGSLLGGKAALTLSGVQPEDEADYYCLLYYGGANWVFGGGTKLTVL

SEQ ID NO: 111 - protein, 124 aa, Artificial Sequence
  Description of Artificial Sequence: Synthetic heavy chain variable region amino acid sequence
EVQLVESGGGLVKPGGSLRLSCAASGFTFINAWMAWVRQAPGKGPEWVGRIKSRADGGTTDYAAPVKGRFTISRDDSKNRLFLQMDSLKTDDTAVYFCTTGVRALRFYNGMDVWGQGTTVTVSS

SEQ ID NO: 112 - protein, 106 aa, Artificial Sequence
  Description of Artificial Sequence: Synthetic light chain variable region amino acid sequence
ETTLTQSPSSLSASIGDRVTITCRAGQSISSFLNWYQQKPGKAPKLLIYAASTLQSGVPSRFSGSKSGTDFTLTISSLQPEDFATYYCQQSYHTFTFGPGTKVEIK

SEQ ID NO: 113 - protein, 130 aa, Artificial Sequence
  Description of Artificial Sequence: Synthetic heavy chain variable region amino acid sequence
QVQLVESGPGLVKPSETLSLTCAVSGYSISSGYYWGWIRQPPGKGLEWIGNIYHSGSTYYNPSLKSRVTISVDTSKNQFSLKLSSVTAADTAVYYCARATLRFTLVREVVVTACDAFDIWGQGTTVTVSS

SEQ ID NO: 114 - protein, 111 aa, Artificial Sequence
  Description of Artificial Sequence: Synthetic light chain variable region amino acid sequence
QSALTQPASVSGSPGQSITISCTGTSSDVGSYNLVSWYQQHPGKVPKLVIYEVNKRPSGVSNRFSGSKSGNTASLTISGLQAEDEADYYCCSYAGSSTFVVFGGGTKLTVL

SEQ ID NO: 115 - protein, 125 aa, Artificial Sequence
  Description of Artificial Sequence: Synthetic heavy chain variable region amino acid sequence
QVQLVESGGGLVQPGGSLRLSCAAAGFSFSNYAMSWVRQAPGKGLEWVAVISGNAGSTYYAESVKGRFTISRDNSKNTLHLQMNSLRGEDTAVYYCAKPPGIAVAGEYYWYFDLWGRGTLVTVSS

SEQ ID NO: 116 - protein, 108 aa, Artificial Sequence
  Description of Artificial Sequence: Synthetic light chain variable region amino acid sequence
QVQLMQPPSVSVSPGQTARITCSGDALPRENAYWYQQKSGQAPVLVIYEDSKRPSGIPERFSGSSSGTMATLTITGAQVEDEADYYCYSTDTSAYHWVFGGGTKLTVL

SEQ ID NO: 117 - protein, 122 aa, Artificial Sequence
  Description of Artificial Sequence: Synthetic heavy chain variable region amino acid sequence
EVQLLESGAEVKKPGSSVKVSCKASGGTFSSYGISWVRQAPGQGLEWMGGIIPIFGTSNYAQKFQGRVTITADESTSTAYMELSSLRSEDTAVYYCALDSSGRARYYAMDVWGQGTTVTVSS

SEQ ID NO: 118 - protein, 107 aa, Artificial Sequence
  Description of Artificial Sequence: Synthetic light chain variable region amino acid sequence
DIQVTQSPATLSLSPGERATLSCRASQSVSSYLAWYQQKPGQAPRLLIYDASNRATGIPARFSGSGSGTDFTLTISSLEPEDFAVYYCQQRNNWPPTFGPGTKVEIK

SEQ ID NO: 119 - protein, 122 aa, Artificial Sequence
  Description of Artificial Sequence: Synthetic heavy chain variable region amino acid sequence
QVQLVESGGGLVKPGGSLRLSCAASGFSFTGFYMNWVRQAPGKGLEWVSSISSSSTYKNYADSLQGRFTISRDNARSSLYLQMNSLRAEDTAVYYCARTRTEYTYGYYHDFWGQGTLVTVSS

SEQ ID NO: 120 - protein, 110 aa, Artificial Sequence
  Description of Artificial Sequence: Synthetic light chain variable region amino acid sequence
QPVLTQPPSVSGAPGQRVTISCTGSSSNIGAGYDVHWYQQVPGTAPKLLIYNNNNRPSGVPDRFSGSKSGTSASLAITGLQAEDEADYYCQSYDSRLSGVFGGGTKLTVL

SEQ ID NO: 121 - protein, 117 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARGSEYYFDYWGQGTLVTVSS

SEQ ID NO: 122 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVVFGGGTKVTVL

SEQ ID NO: 123 - protein, 126 aa, Artificial Sequence
  Description of Artificial Sequence: Synthetic heavy chain variable region amino acid sequence
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDDTYYYDSSGYSAPFDYWGQGTLVTVSS

SEQ ID NO: 124 - protein, 107 aa, Artificial Sequence
  Description of Artificial Sequence: Synthetic light chain variable region amino acid sequence
DIQVTQSPSTLSASVGDRVTITCRASQSISSWLAWYQQKPGKAPKLLIYKASSLESGVPSRFSGSGSGTEFTLTISSLQPDDFATYYCQQYNSYPWTFGQGTKVEIK

SEQ ID NO: 125 - protein, 123 aa, Artificial Sequence
  Description of Artificial Sequence: Synthetic heavy chain variable region amino acid sequence
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARELRYFDWEYGGMDVWGQGTTVTVSS

SEQ ID NO: 126 - protein, 108 aa, Artificial Sequence
  Description of Artificial Sequence: Synthetic light chain variable region amino acid sequence
EIVLTQSPSSLSASVGDRVTITCQASQDISNYLNWYQQKPGKAPKLLIYDASNLETGVPSRFSGSGSGTDFTFTISSLQPEDIATYYCQQYDNLPMYTFGQGTKLEIK

SEQ ID NO: 127 - protein, 126 aa, Artificial Sequence
  Description of Artificial Sequence: Synthetic heavy chain variable region amino acid sequence
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDDTYYYDSNGYSAPFDYWGQGTLVTVSS

SEQ ID NO: 128 - protein, 107 aa, Artificial Sequence
  Description of Artificial Sequence: Synthetic light chain variable region amino acid sequence
DIQVTQSPSTLSASVGDRVTITCRASQSISSWLAWYQQKPGKAPKLLIYKASSLESGVPSRFSGSGSGTEFTLTISSLQPDDFATYYCQQYNSYPWTFGQGTKVDIK

SEQ ID NO: 129 - protein, 131 aa, Artificial Sequence
  Description of Artificial Sequence: Synthetic heavy chain variable region amino acid sequence
EVQLLESGPGLVKPSQTLSLTCAVSGGSINSGRYSWSWIRQPPGKGLEWIGYIYYSGTTYYNPSLESRVTISRDTSKNQFSLNLSSVTAADTAVYYCARTNSADSYASGSHYIRPQYFDFWGQGTLVTVSS

SEQ ID NO: 130 - protein, 106 aa, Artificial Sequence
  Description of Artificial Sequence: Synthetic light chain variable region amino acid sequence
DIQLTQSPATLSLSPGERATLSCRASQSVSSYLAWYQQKPGQAPRLLIYGASNRATGIPARFSGSGSGTDFTLTISRLEPEDFAVYYCQQRSNWLTFGGGTKVEIK

SEQ ID NO: 131 - protein, 130 aa, Artificial Sequence
  Description of Artificial Sequence: Synthetic heavy chain variable region amino acid sequence
QVQLVQSGGGVVQPGRSLRLSSAASGFTFSSYAMHWVRQAPGKGLEWVAVISHDGSKYYADSVKGRFTISRDNSKSTLNLQMNSLRPEDTAVYYCARGGDVRLYDDSNGYHYDTYYFDYWGQGTLVTVSS

SEQ ID NO: 132 - protein, 107 aa, Artificial Sequence
  Description of Artificial Sequence: Synthetic light chain variable region amino acid sequence
EIVLTQSPSSLSASVGDRVTITCRASQGIRNDLGWYQQKPGKAPKLLIYAASTLQSGVPSRFSGSGSGTDFTLTISSLQPEDFATYYCLQDYNYPLTFGGGTKVEIK

SEQ ID NO: 133 - protein, 124 aa, Artificial Sequence
  Description of Artificial Sequence: Synthetic heavy chain variable region amino acid sequence
QVQLVQSGGGLVKPGGSLRLSCAASGFTFSSYSMHWVRQAPGKGLEWVSSISASSSYLNYADSVKGRFTISRDNAKKSLYLQLNTLRADDTAVYYCAREDHDSGTYYLNWFDPWGQGTLVTVSS

SEQ ID NO: 134 - protein, 111 aa, Artificial Sequence
  Description of Artificial Sequence: Synthetic light chain variable region amino acid sequence
QSVVTQPPSVSGAPGQRVTISCTGSSSNIGAGYDVHWYQQFPGTGPKLLIYGNSHRPSGVPDRFSGSKSGPSASLAITGLQAEDEADYYCQSYDSSLSGYVFGTGTKVTVL

SEQ ID NO: 135 - protein, 121 aa, Artificial Sequence
  Description of Artificial Sequence: Synthetic heavy chain variable region amino acid sequence
QVQLVQSGAEVKKPGASVKVSCKTSGYTFTNYGISWVRQAPGQGLEWMGWISAYNGNRNYAQKLQGRVTMTTDTSTSTAYMELRSLRSDDTAVYYCAREPPVIAAGDFSHWGQGTLVTVSS

SEQ ID NO: 136 - protein, 112 aa, Artificial Sequence
  Description of Artificial Sequence: Synthetic light chain variable region amino acid sequence
EIVLTQSPLSLPVTLGQPASISCRSSQSLVHSDANTYLSWFQQRPGQSPRRLIYKVSNRDSGVPDRFSGSGSGTDFTLKISRVEAEDVGVYYCMQGTHWPPDFGQGTRLEIK

SEQ ID NO: 137 - protein, 124 aa, Artificial Sequence
  Description of Artificial Sequence: Synthetic heavy chain variable region amino acid sequence
QVQLVESGGGLGKPGGSLRLSCAASGFTFSGYYMSWIRQAPGKGLEWVSDISSGSSFTNYADSVKGRFTISRDNAKNSLYLQMNSLKAEDTAVYYCARVPPDSYGSGSYSGDSWGQGTLVTVSS

SEQ ID NO: 138 - protein, 111 aa, Artificial Sequence
  Description of Artificial Sequence: Synthetic light chain variable region amino acid sequence
QSVVTQPPSVSGAPGQRVTISCTGSSSNIGAGYGVHWYQQLPGTAPKLLIYGNTNRPSGVPDRISGSKSGTSASLVITGLQAEDEADYYCQSYDSSLSGWVFGGGTKLTVL

SEQ ID NO: 139 - protein, 118 aa, Artificial Sequence
  Description of Artificial Sequence: Synthetic heavy chain variable region amino acid sequence
EVQLVESGGGLVQPGGSLRLSCAASGFTFSNFEMNWVRQAPGKGLEWVSYISSSGRIIYYADSVKGRFTISRDNARNSLYVQMNSLRVEDTAVYYCARAKAAAGHDLWGQGTLVTVSS

SEQ ID NO: 140 - protein, 107 aa, Artificial Sequence
  Description of Artificial Sequence: Synthetic light chain variable region amino acid sequence
EIVLTQSPSTLSASVGDRVTITCRASQSISPWLAWYQQKPGKAPKLLIYRASSLESGVPSRFSGSGSGTEFTLTISSLQPDDFATYYCQHYNSYLYTFGQGTKVEIK

SEQ ID NO: 141 - protein, 122 aa, Artificial Sequence
  Description of Artificial Sequence: Synthetic heavy chain variable region amino acid sequence
QVQLVQSGTEVKKPGASVKVSCKASGYTFTNYDISWVRQAPGQGLEWMGWISGSTGNTIYAQNLQGRLTMTTDTSTSTAYMELRSLRSDDTAIYYCARDNVGYASGNYFDYWGQGTLVTVSS

SEQ ID NO: 142 - protein, 108 aa, Artificial Sequence
  Description of Artificial Sequence: Synthetic light chain variable region amino acid sequence
SYVLTQPPSVSVAPGKTARIPCGGNNIGSKSVHWYQQRPGQAPVLVIYYDSVRPSGIPERFSGSNSGNTATLTISTVEAGDEADFYCQVWDSSRDHEVFGGGTKLTVL

SEQ ID NO: 143 - protein, 118 aa, Artificial Sequence
  Description of Artificial Sequence: Synthetic heavy chain variable region amino acid sequence
QVQLVQSGAEVKKPGESLKISCKGSGYKFTNYWIAWVRQMPGKGLEWLGVIYPGASDITYSPSFQGQVTISADKSISTAYLQWSSLKASDTAIYYCARQGSITAMSYWGQGTMVTVSS

SEQ ID NO: 144 - protein, 112 aa, Artificial Sequence
  Description of Artificial Sequence: Synthetic light chain variable region amino acid sequence
DIVMTQSPLSLPVTPGEPASISCRSSQSLLHSNGFNYLDWYLQKPGQSPQLLIYLGSNRASGVPDRFSGSGSGTDFTLKISRVEAEDVGVYYCMQALQTPFTFGPGTKVEIK

SEQ ID NO: 145 - protein, 130 aa, Artificial Sequence
  Description of Artificial Sequence: Synthetic heavy chain variable region amino acid sequence
QVQLVQSGGGVVQPGRSLRLSCAASGFTFSSYGMHWVRQAPGKGLEWVAVIWFDGNNKEYADSVKGRFAISRDNSKNTLYLQMNSLRAEDTAVYYCARDLIPVTIFGVVNPYSYYGMDVWGQGTTVTVSS

SEQ ID NO: 146 - protein, 107 aa, Artificial Sequence
  Description of Artificial Sequence: Synthetic light chain variable region amino acid sequence
EIVMTQSPSSLSASVGDRVTITCRASQSISTYLNWYQQKPGTAPKLLIYAASSLESGVPSRLSGSGSGTEFILTISSLQREDFATYYCQQSYSTPPTFGQGTKVEIK

SEQ ID NO: 147 - protein, 126 aa, Artificial Sequence
  Description of Artificial Sequence: Synthetic heavy chain variable region amino acid sequence
QVQLVQSGPALVKTTQTLTLTCTFSGFSLTTSGMCVSWIRQPPGKALEWLARIDWDDDKYYSTSLKTRLTISKDTSKNQVVLTLTNVDPVDTATYYCARMQKYDSSGYYLHYFDSWGQGTLVTVSS

SEQ ID NO: 148 - protein, 108 aa, Artificial Sequence
  Description of Artificial Sequence: Synthetic light chain variable region amino acid sequence
DIRLTQSPSSLSASVGDRVTIACRASQSISSYLNWYQQKPGKSPKVLIYAASILQTGVPSRFSGSGSGTDFTLTISSLQPEDFATYYCQQSYSINQYTFGQGTKVEIK

SEQ ID NO: 149 - protein, 125 aa, Artificial Sequence
  Description of Artificial Sequence: Synthetic heavy chain variable region amino acid sequence
QVQLVQSGGEVKKPGASVKVSCKASGYTFTYYGISWVRQAPGQGLEWMGWISAYNGNTNYEQKFQGRVTMTTDTSTGTAYMELRSLTSDDTAVYYCARDRIVVVTAANYYGLDVWGQGTTVTVSS

SEQ ID NO: 150 - protein, 113 aa, Artificial Sequence
  Description of Artificial Sequence: Synthetic light chain variable region amino acid sequence
DIQLTQSPDSLAVSLGERATINCKSSQSVLYRPNNKNFLAWYQQKPGQPPKLLIYWASTRQSGVPDRFSGSGSGTDFTLTISSLQAEDVAVYYCQQYHTTPLTFGGGTKVDIK

SEQ ID NO: 151 - protein, 125 aa, Artificial Sequence
  Description of Artificial Sequence: Synthetic heavy chain variable region amino acid sequence
QVQLQQWGAGLLKPSETLSLTCAIYSGSFSGYYWSWIRQPPGKGLEWIGQINYSGSAYYTPSLKSRVTISVDTSKNQFSLKLSSVTAADTAVYYCARVRITMVQGAIVPCAIDVWGQGTTVTVSS

SEQ ID NO: 152 - protein, 110 aa, Artificial Sequence
  Description of Artificial Sequence: Synthetic light chain variable region amino acid sequence
SYELTQPPSASGTPGQRVTISCSGSSSNIESNFVYWYQQLPGTAPKLLIHRNDQRPSGVPDRFSGSKSGTSASLAISGLRSEDEADYSCAAWDDSLSGVVFGGGTKVTVL

SEQ ID NO: 153 - protein, 124 aa, Artificial Sequence
  Description of Artificial Sequence: Synthetic heavy chain variable region amino acid sequence
QVQLVQSGAEVKKPGASVKLSCKASGYTFTRFYIHWVRQAPGQGLEWMGIINPSGGGTSYAQNFQDRVTMTRDTSTSTVYMELSSLRSEDTAVYYCARNGYSTRSLQNNWFDPWGQGTLVTVSS

SEQ ID NO: 154 - protein, 108 aa, Artificial Sequence
  Description of Artificial Sequence: Synthetic light chain variable region amino acid sequence
ETTLTQSPSSLSASVGDRVTITCRASQSIDNYLNWYQQKPGKAPKLLIYEASSLQSGVPSRFSGSGSGTDFTLTISSLQPEDFATYYCQQTYSSLPYTFGQGTKVEIK

SEQ ID NO: 155 - protein, 124 aa, Artificial Sequence
  Description of Artificial Sequence: Synthetic heavy chain variable region amino acid sequence
QVQLVQSGAEVKKPGASVKVSCKASGYTFTRYGISWVRQAPGQGLEWMGWISDYNGNTKNAEKFQGRVTMTTDTYTNIAYMELRSLRSDDTAVYYCARDWWITVGGIIAPFDYWGQGTLVTVSS

SEQ ID NO: 156 - protein, 107 aa, Artificial Sequence
  Description of Artificial Sequence: Synthetic light chain variable region amino acid sequence
ETTLTQSPGTLSLSPGERATLSCRASQSVSSDYLAWFQQKPGQAPRLLIYGASSRATDIPDRFSGSGSGTDFTLTISRLESEDFAVYYCLHYAGARTFGQGTKVEIK

SEQ ID NO: 157 - protein, 123 aa, Artificial Sequence
  Description of Artificial Sequence: Synthetic heavy chain variable region amino acid sequence
EVQLVESGGVVVQPGGSLRLSCAASGFNFDDYSMHWVRQAPGKGLEWVSVISWDGGITYYADSVKGRFTMSRDNGKKSLYLQMNSLRTEDTAVYYCGKDGDIYSSSSAGIDYWGQGTLVTVSS

SEQ ID NO: 158 - protein, 110 aa, Artificial Sequence
  Description of Artificial Sequence: Synthetic light chain variable region amino acid sequence
SYVLTQPPSASGTPGQRVIISCSGSSSNIGSHTVKWYQQLPGTAPKLLIDRNNQRPSGVPDRFSGPKSGTSASLAISGLQSEDEADYYCASWDDSLNGPVFGGGTQLTVL

SEQ ID NO: 159 - protein, 122 aa, Artificial Sequence
  Description of Artificial Sequence: Synthetic heavy chain variable region amino acid sequence
QVQLVQSGAEVKKPGSSMKVSCKASGGSFSSYGISWLRQAPGQAPEWMGGIIPIFGTINYAQKFQGRITISADESTSTVYMELSSLRIEDTAVYYCARDGRTSPRYYGWDVWGQGTTVTVSS

SEQ ID NO: 160 - protein, 108 aa, Artificial Sequence
  Description of Artificial Sequence: Synthetic light chain variable region amino acid sequence
DIRLTQSPATLSLSPGDRATLSCRASQSLYTYLSWYQQKPGQAPRLLIYDASNRATGIPARFSGSGSGTDFTLTISSLEPEDFAVYYCHYRSNWPPCTFGGGTKVDIK

SEQ ID NO: 161 - protein, 125 aa, Artificial Sequence
  Description of Artificial Sequence: Synthetic heavy chain variable region amino acid sequence
EVQLVESGPGLVKPSETLSLTCTVSGGSISNYYWTWIRQPPGEGLEWIGYIYYTGSTNYNPSLKNRVTISVDTPKNQFSLKLNSVTAADTAVYYCARGWGYSYGYESYYNGLDVWGQGTTVTVSS

SEQ ID NO: 162 - protein, 107 aa, Artificial Sequence
  Description of Artificial Sequence: Synthetic light chain variable region amino acid sequence
DIQLTQSPSFLSASVGDRVTITCRASQGISSYLAWYQLKPGKAPKLLIYAAATLETGVPSRFSGSGSGTEFTLTISGLQPEDFATYYCQQLNSFPFTFGPGTKVEIK

SEQ ID NO: 163 - protein, 123 aa, Artificial Sequence
  Description of Artificial Sequence: Synthetic heavy chain variable region amino acid sequence
QVQLVQSGAEVKKPGESLKISCKGSGDTFSRNWIGWVRQMPGKGLEWMGIIWPGDSDTRYRQFFQGQQGQVIISVDKSISTAYLQWSSLKASDTATYYCATSPYGLGSYYEHWGQGTLVTVSS

SEQ ID NO: 164 - protein, 111 aa, Artificial Sequence
  Description of Artificial Sequence: Synthetic light chain variable region amino acid sequence
NFMLTQPHSLSDSPGKTVVISCTRSSGSIASNYVQWYQQRPGSAPTTVIYEDNQRPSGVPDRFSGSIDSSSNSASLTISGLKTEDEADYYCQSYDSSNPYVFGTGTKVTVL

SEQ ID NO: 165 - protein, 119 aa, Artificial Sequence
  Description of Artificial Sequence: Synthetic heavy chain variable region amino acid sequence
EVQLVESGGGLVKPGGSLRLSCAASGFSFSSYSMHWVRQAPGKGLEWVSSISGSSTYIYHADSVKGRFTISRDNAERSLHLQMNSLRAEDTAVYYCARDPYSSGWLDSWGQGTLVTVSS

SEQ ID NO: 166 - protein, 108 aa, Artificial Sequence
  Description of Artificial Sequence: Synthetic light chain variable region amino acid sequence
ETTLTQSPATLSVSPGERATLSCRASQSVSGNLAWYQQKPGQAPRLLIYGTSTRATGIPARFSGSGSGTEFTLSISSLQSEDFAVYYCQQYNKWPRYTFGQGTKLEIK

SEQ ID NO: 167 - protein, 121 aa, Artificial Sequence
  Description of Artificial Sequence: Synthetic heavy chain variable region amino acid sequence
QVQLVQSGAEVKKPGSSVKVSCKASGGTFTNYNINWVRQAPGQGLQWMGRISPTFAIANYAQKFQGRVTITADKSTSTAYMELSSLRSEDTAVYYCARAPHSGYDLALDYWGQGTLVTVSS

SEQ ID NO: 168 - protein, 107 aa, Artificial Sequence
  Description of Artificial Sequence: Synthetic light chain variable region amino acid sequence
DIQMTQSPSTLSASVGDRVTITCRASQSISSWLAWYQQKPGKAPKLLIYEASSLQSGVPSRFSGSGSGTEFTLTITSLQPDDFATYYCQQYNVYPWTFGQGTKVDIK

SEQ ID NO: 169 - protein, 126 aa, Artificial Sequence
  Description of Artificial Sequence: Synthetic heavy chain variable region amino acid sequence
EVQLVESGGGVVQPGGSLRLSCAASGFSFSDYGMHWVRQAPGKGLEWVSFIRYDASYKFYADSVKGRFTISRDNAKNTLYLQINSLRAEDTAVYYCAKEIYGSGSYYYYYYAIDVWGQGTTVTVSS

SEQ ID NO: 170 - protein, 108 aa, Artificial Sequence
  Description of Artificial Sequence: Synthetic light chain variable region amino acid sequence
EIVLTQSPGTLSLSPGERATLSCRASQSVSSSHLAWYQQKPGQAPRLLIYGASSRATGIPDRFSGSGSGTDFTLTISRLEPEDFAVYYCQQYFRSAWAFGQGTKVDIK

SEQ ID NO: 171 - protein, 123 aa, Artificial Sequence
  Description of Artificial Sequence: Synthetic heavy chain variable region amino acid sequence
EVQLVESGGVVVQPGGSLRLSCAASGFNFDDYAMHWVRQAPGKGLEWVSLISWDGGNTYYSDSVKGRFTISRDNGKNSLYLQMNSLRAEDTALYYCAKDIDRYSGYDYVFHYWGQGTLVTVSS

SEQ ID NO: 172 - protein, 106 aa, Artificial Sequence
  Description of Artificial Sequence: Synthetic light chain variable region amino acid sequence
DIRLTQSPSTLSAYVGDRVTITCRASQSISSWLAWYQQKPGKAPKLLIYKASSLESGVPSRFTGSGSGTEFTLTISGLQPDDFATYYCQQYNSYSTFGGGTKVDIK

SEQ ID NO: 173 - protein, 124 aa, Artificial Sequence
  Description of Artificial Sequence: Synthetic heavy chain variable region amino acid sequence
QVQLVQSGAEVKKPGESLKISCKGSGYNSSINWIGYWIGWVRQMPGKGLEWMGIINPGDSDTRYSPSFQGQVTISVDKSISTAYLQWGSLKASDTAMYYCARRAYRSGWHFDLWGRGTLVTVSS

SEQ ID NO: 174 - protein, 108 aa, Artificial Sequence
  Description of Artificial Sequence: Synthetic light chain variable region amino acid sequence
EIVMTQSPATLSVSPGERATLTCRASQSVSSNLAWYQQKPGQAPRLLIYGASTRATGIPARFSGSGSGTQFTLTISSLQSEDFAVYYCQHYNNWPPYTFGQGTKVEIK

SEQ ID NO: 175 - protein, 119 aa, Artificial Sequence
  Description of Artificial Sequence: Synthetic heavy chain variable region amino acid sequence
QVQLVQSGAEVKKPGSSVKVSCKASGGTFSSYTINWVRQAPGQGLEWMGRIIPILGIANYAQKFQGRVTITADKSTSTAYMELSSLRSEDTAVYYCARRHQDTYGMDVWGQGTTVTVSS

SEQ ID NO: 176 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKVTVL

SEQ ID NO: 177 - protein, 123 aa, Artificial Sequence
  Description of Artificial Sequence: Synthetic heavy chain variable region amino acid sequence
EVQLVESGGVVIQPGGSLRLSCAASGFNFDDYSMHWVRQAPGKGLEWVSLISWDGGITYYADSVKGRFTISRDNGKKSLYLQMNSLRTEDTALYYCAKDIDIYSDYAGYFDYWGQGTLVTVSS

SEQ ID NO: 178 - protein, 107 aa, Artificial Sequence
  Description of Artificial Sequence: Synthetic light chain variable region amino acid sequence
DIRMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGQGTRLEIK

SEQ ID NO: 179 - protein, 118 aa, Artificial Sequence
  Description of Artificial Sequence: Synthetic heavy chain variable region amino acid sequence
QVQLVQSGAEVKKPGESLKISCKGPDSSFSVYWIAWVRQMPGKGLEWMGVIYVGDSDTRYSPSFRGQVTISADKSMNTAYLQWSSLKASDTAMYFCARHIPPGPFDLWGQGTMVTVSS

SEQ ID NO: 180 - protein, 110 aa, Artificial Sequence
  Description of Artificial Sequence: Synthetic light chain variable region amino acid sequence
NFMLTQPHSVSASPGKTITISCTRSSGSIASNSVQWYQQRPGSAPTNVIYEDDQRPLGVPNRFSGSIDSSSNSASLTISGLKTEDEADYYCHSYHNSDQVFGGGTKLTVL

SEQ ID NO: 181 - protein, 123 aa, Artificial Sequence
  Description of Artificial Sequence: Synthetic heavy chain variable region amino acid sequence
QVQLQESGPGLVKPSETLSLTCTVSGGSVRSGSYYWSWIRQPPGKALEWIGYIYYSGSTNYNPALESRVTISVDTSKNQFSLMLSSVTAADTAVYYCARSAEGLARLYYFDHWGQGTLVTVSS

SEQ ID NO: 182 - protein, 111 aa, Artificial Sequence
  Description of Artificial Sequence: Synthetic light chain variable region amino acid sequence
QSVLIQPASVSGSPGQSITISCTGTSSDVGGYNYVSWYQQHPGKAPKLMIHDVSNRPSGVSNRFSGSKSGNTASLTISGLQAEDEADYYCSTYRSSNTLVVFGGGTKLTVL

SEQ ID NO: 183 - protein, 119 aa, Artificial Sequence
  Description of Artificial Sequence: Synthetic heavy chain variable region amino acid sequence
EVQLVESGGGVVQPGRSLRLSCAASGFTFSSFPMHWVRQAPGKGLEWVAVASYDGRNNYYAGSVKGRFTISRDNSKNTLYLQINSLRAEDTAVYYCAREVVIAAHFDYWGQGTLVTVSS

SEQ ID NO: 184 - protein, 108 aa, Artificial Sequence
  Description of Artificial Sequence: Synthetic light chain variable region amino acid sequence
SSELTQEPAVSVALGQTVRITCQGDSLRSFYANWYQQKPGQAPILVIYGKNDRPSGIPDRFSGSNSGNTASLTITGAQAEDEADYYCNSRDSSGNHRVFGGGTKVTVL

SEQ ID NO: 185 - protein, 119 aa, Artificial Sequence
  Description of Artificial Sequence: Synthetic heavy chain variable region amino acid sequence
QVQLVQSGAEVKKPGSSVKVSCKASGGTFNSYTINWVRQAPGQGLEWMGRIITIPGATNYAQKFQGRVTFTADKSTSTAYMELSSLRSEDTAVYFCAKRGTGYYGMDVWGQGTTVTVSS

SEQ ID NO: 186 - protein, 110 aa, Artificial Sequence
  Description of Artificial Sequence: Synthetic light chain variable region amino acid sequence
QSVLIQPRSVSGSPGQSVTISCTGTSSDVGGYNYVSWYQQHPGKAPKLMIYDVSERPSGVPDRFSGSKSGNTASLTISGLQAEDEADYYCCSFVGIYILVFGGGTKLTVL

SEQ ID NO: 187 - protein, 122 aa, Artificial Sequence
  Description of Artificial Sequence: Synthetic heavy chain variable region amino acid sequence
EVQLLESGGGLVKPGGSLRLSCAASGFTFSDHYMSWIRQAPGKGLEWVSYISSTSSFTNYADSLKGRFTISRDNAKNSLYLQMNSLRAEDTAVYYCARPYIVALGTRAFDIWGQGTTVTVSS

SEQ ID NO: 188 - protein, 108 aa, Artificial Sequence
  Description of Artificial Sequence: Synthetic light chain variable region amino acid sequence
SYVLTQPPSVSVAPGKTARITCGGNNIGSKTVHWYQQKPGQAPVLVSYYDSDRPSGIPERFSGSNSGNTATLTISRVEAGDEADYYCQVWDGSSEHYVFGTGTKVTVL

SEQ ID NO: 189 - protein, 120 aa, Artificial Sequence
  Description of Artificial Sequence: Synthetic heavy chain variable region amino acid sequence
QVQLVQSGTEVKKPGSSVKVSCKASGGTFSSYTISWVRQAPGQGLEWMGGITPMVGTPNYAQKFQGRVAITADKSTNTAYMELTSLISGDTAVYYCARLVYGSGSHFDYWGQGTLVTVSS

SEQ ID NO: 190 - protein, 108 aa, Artificial Sequence
  Description of Artificial Sequence: Synthetic light chain variable region amino acid sequence
SSELSQDPAVSVALGQTVRITCQGDSLRSFYASWYQQQPGQAPVLVLYGQDNRPSGIPDRFSGSSSGNTASLTITGAQAEDEADYYCNSRNSSGHHWVFGGGTKVTVL

SEQ ID NO: 191 - protein, 131 aa, Artificial Sequence
  Description of Artificial Sequence: Synthetic heavy chain variable region amino acid sequence
EVQLLESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDRFCSSTSCEYYYYYYGMDVWGQGTTVTVSS

SEQ ID NO: 192 - protein, 107 aa, Artificial Sequence
  Description of Artificial Sequence: Synthetic light chain variable region amino acid sequence
ETTLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 193 - protein, 119 aa, Artificial Sequence
  Description of Artificial Sequence: Synthetic heavy chain variable region amino acid sequence
QVQLLESGGGVVQPGRSLRLSCAASGFTFSSFPMHWVRQAPGKGLEWVAVASYDGRNNYYAGSVKGRFTISRDNSKNTLYLQINSLRAEDTAVYYCAREVVIAAHFDYWGQGTLVTVSS

SEQ ID NO: 194 - protein, 108 aa, Artificial Sequence; identical to SEQ ID NO: 184
  Description of Artificial Sequence: Synthetic light chain variable region amino acid sequence

SEQ ID NO: 195 - protein, 116 aa, Artificial Sequence
  Description of Artificial Sequence: Synthetic heavy chain variable region amino acid sequence
QVQLVQSGAEVKKPGASVRVSCKASGYTFNSYSISWVRQAPGQGLEWMGWISVHNGNTNYTQKFQGRVTMTTDTSTSTTYMELRSLRSDDTAVYYCIFGELLYDVWGQGTTVTVSS

SEQ ID NO: 196 - protein, 107 aa, Artificial Sequence
  Description of Artificial Sequence: Synthetic light chain variable region amino acid sequence
DIQLTQSPSSLSASVGDRVTITCRASQGISNYLAWYQQKPGKVPNLLIYAASTLQSGVPSRFSGSGSGTDFTLTISSLQPEDVATYYCQKYNSAPLTFGPGTKVEIK

SEQ ID NO: 197 - protein, 122 aa, Artificial Sequence
  Description of Artificial Sequence: Synthetic heavy chain variable region amino acid sequence
EVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDIAAAGTMRAFDIWGQGTTVTVSS

SEQ ID NO: 198 - protein, 111 aa, Artificial Sequence
  Description of Artificial Sequence: Synthetic light chain variable region amino acid sequence
QSVLIQPASVSGSPGQSITISCTGTSSDVGGYNYVSWYQQHPGKAPKLMIYDVSNRPSGVSNRFSGSKSGNTASLTISGLQAEDEADYYCSSYTSSSTLVVFGGGTKLTVL

SEQ ID NO: 199 - protein, 119 aa, Artificial Sequence
  Description of Artificial Sequence: Synthetic heavy chain variable region amino acid sequence
QVQLVESGGGFVKPGGSLRLSCAASGFTFSDYYMSWIRQAPGKGLEWLSYISSTSLFTYYADSVKGRFTISRDNAKNSLYLQMNSLRADDTAVYYCARAYGKGTMVGYWGQGTMVTVSS

SEQ ID NO: 200 - protein, 108 aa, Artificial Sequence
  Description of Artificial Sequence: Synthetic light chain variable region amino acid sequence
EIVMTQSPGTLSLAPGERATLSCRASQSVSIDYLAWYQHKPGQAPRLLIYTASNRATGIPDRFSGSGSGTDFTLTISRLEPEDVAMYYCQQYGNSPYTFGQGTKVEIK

SEQ ID NO: 201 - protein, 125 aa, Artificial Sequence
  Description of Artificial Sequence: Synthetic heavy chain variable region amino acid sequence
QVQLVQSGAEVKKPGSSVKVSCKASGGTFSTYTITWVRQAPGQGLEWMGRIVPIFGVVNNAQKFLGRLTITADKSTSTAYMELSSLRSEDTAVYYCARIPCSGNCQDYYYGMDVWGQGTTVTVSS

SEQ ID NO: 202 - protein, 107 aa, Artificial Sequence
  Description of Artificial Sequence: Synthetic light chain variable region amino acid sequence
DIQLTQSPSFLSASVGDRVTITCRASQGISSYLVWYQQKPGKAPKLLIYAASTLQSGVPSRFSGSGSGTEFTLTISSLQPEDFATYYCQQLNNYPPTFGPGTKVDIK

SEQ ID NO: 203 - protein, 125 aa, Artificial Sequence
  Description of Artificial Sequence: Synthetic heavy chain variable region amino acid sequence
QVQLVQSGGGLVKPGGSLRLSCAASGFTFSNAWISWVRQAPGKGLEWVGRIKSATDGGTTDYAAPVKGRFTISRDDSKNTLYLQMDSLKTEDTAVYYCTTSYPYFDWLPFSVDYWGQGTLVTVSS

SEQ ID NO: 204 - protein, 110 aa, Artificial Sequence
  Description of Artificial Sequence: Synthetic light chain variable region amino acid sequence
SYELMQPPSASGTPGQRVTISCSGSNSNIGSNTVSWYQQLPGTAPKLLIYNNNQRPSGVPDRFSGSKSGTSASLAISGLQSEDEADYYCATWDDSLNGWVFGGGTKLTVL

SEQ ID NO: 205 - protein, 120 aa, Artificial Sequence
  Description of Artificial Sequence: Synthetic heavy chain variable region amino acid sequence
QVQLVQSGAEVKKPGASVKVSCKASGYTFTTYGISWVRQAPGQGLEWMGWISTYKTYTNYAQKFQGRVTMTTDTSTSTAYMELRSLRSDDTAVYYCAKVAGGSGSYGDYWGQGTLVTVSS

SEQ ID NO: 206 - protein, 108 aa, Artificial Sequence
  Description of Artificial Sequence: Synthetic light chain variable region amino acid sequence
QPVLTQPPSVSVAPGKTARITCGGNNIGSKSVHWYLQKPGQAPVLVIYYDSDRPSGIPERFSGSNSGNTATLTISRVEAGDEADFFCQVWDSSSDHWVFGGGTKVTVL

SEQ ID NO: 207 - protein, 119 aa, Artificial Sequence
  Description of Artificial Sequence: Synthetic heavy chain variable region amino acid sequence
QVQLVQSGAEVKKPGSSVKVSCKASGGTFSSYTISWVRQAPGQGLEWMGRIIPILGIANYAQKFQGRVTITADKSTSTAYMELSSLRSEDTAVYYCARPSSSSFAFDYWGQGTLVTVSS

SEQ ID NO: 208 - protein, 111 aa, Artificial Sequence
  Description of Artificial Sequence: Synthetic light chain variable region amino acid sequence
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTPVVFGGGTKVTVL

SEQ ID NO: 209 - protein, 121 aa, Artificial Sequence
  Description of Artificial Sequence: Synthetic heavy chain variable region amino acid sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDPPVIAAGDFQHWGQGTLVTVSS

SEQ ID NO: 210 - protein, 112 aa, Artificial Sequence
  Description of Artificial Sequence: Synthetic light chain variable region amino acid sequence
DIVLTQSPLSLPVTLGQPASISCRSSQSLVHSDGNTYLNWFQQRPGQSPRRLIYKVSNRDSGVPDRFSGSGSGTDFTLKISRVEAEDVGVYYCMQGTHWPPDFGQGTRLEIK

SEQ ID NO: 211 - protein, 121 aa, Artificial Sequence
  Description of Artificial Sequence: Synthetic heavy chain variable region amino acid sequence
QVQLVQSGAEVKKPGASVKVSCKASGYTFTNYGITWVRQAPGQGLEWMGWISAYNGVRNYAQKLQGRVTMTIDTSRTTAYMELKNLRSDDTAMYYCARGPPVIAADDFQHWGQGTMVTVSS

SEQ ID NO: 212 - protein, 112 aa, Artificial Sequence
  Description of Artificial Sequence: Synthetic light chain variable region amino acid sequence
DIQMTQSPLSLPVTLGQPASISCRSSQSLVHSNGDTYLNWFQQRPGRSPRRLIYKVSNRDSGVPDRFSGSGSGTDFTLKISRVEAEDVGVYYCMQGTHWPPDFGQGTRLEIK

SEQ ID NO: 213 - protein, 125 aa, Artificial Sequence
  Description of Artificial Sequence: Synthetic heavy chain variable region amino acid sequence
QVQLVQSGAEVKKPGSSVKVSCKASGGTFNNYAINWVRQAPGQGLEWMGGIIPMFGTANYAQKFQGRVTMTADESTSTAYMELSSLRSEDTAVYYCASSQIFVGGNYYKLEFDNWGQGTLVTVSS

SEQ ID NO: 214 - protein, 110 aa, Artificial Sequence
  Description of Artificial Sequence: Synthetic light chain variable region amino acid sequence
QSVLTQPPSVSAAPGQKVTISCSGSNSNIGYNDVSWYQQLPGTAPQLLIYDNNKRTSGIPDRFSGSKFGTSATLGITGLQTGDEADYYCGTWDSSLSTVIFGGGTKLTVL

SEQ ID NO: 215 - protein, 122 aa, Artificial Sequence
  Description of Artificial Sequence: Synthetic heavy chain variable region amino acid sequence
QVQLVQSGAEVKKPGESLKISCKVSGYSFTSYWIGWVRQMPGKGLEWMGIIYPGDSDTRYSPSFQGQVTISADKSITTAYLQWSSLKASDTAMYYCARPAHSSSWYGAFDLWGQGTTVTVSS

SEQ ID NO: 216 - protein, 107 aa, Artificial Sequence
  Description of Artificial Sequence: Synthetic light chain variable region amino acid sequence
DIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIK

SEQ ID NO: 217 - protein, 121 aa, Artificial Sequence
  Description of Artificial Sequence: Synthetic heavy chain variable region amino acid sequence
QVQLVQSGAEVKKPGSSVKVSCKASGGTFSSYTINWVRQAPGQGLEWMGRIIPVLGMASYVQNFQGRVSITADESTSTAYMELSSLTSEDTALYYCAKGAVAAANDVFDVWGQGTTVTVSS

SEQ ID NO: 218 - protein, 113 aa, Artificial Sequence
  Description of Artificial Sequence: Synthetic light chain variable region amino acid sequence
DIQMTQSPDSLAVSLGERATINCKSSQSVFYSSNNKHYLAWYQQKPGQPPKLLFYWASTRESGVPDRFSGSGSGTDFTLTISSLQAEDVAVYYCQQYYRIPYTFGQGTKVEIK

SEQ ID NO: 219 - protein, 120 aa, Artificial Sequence
  Description of Artificial Sequence: Synthetic heavy chain variable region amino acid sequence
QVQLVQSGAEVKKPGSSVKVSCKASGGTFSSHAFSWVRQAPGQGLEWMGGIIPSLNTANYAQKFQGRVSITADESTGTAYMELSSLRSDDTAVYFCAREVFGYGYYFDYWGQGTLVTVSS

SEQ ID NO: 220 - protein, 108 aa, Artificial Sequence
  Description of Artificial Sequence: Synthetic light chain variable region amino acid sequence
ETTLTQSPATLSVSPGERATLSCRASQNVNSNLAWYQQKPGQAPRLLIYGASTRATGIPARFSGSGSGTDFTLTISSLQSEDFAVYYCQQYNMWPPFTFGQGTKLEIK

SEQ ID NO: 221 - protein, 118 aa, Artificial Sequence
  Description of Artificial Sequence: Synthetic heavy chain variable region amino acid sequence
QVQLVQSGAEVKKPGESLKISCKGPDSSFSVYWIAWVRQMPGKGLEWMGVIYVGDSDTRYSPSFRGQVTISADKSINTAYLQWSSLKASDTAMYFCARHIPPGPFDLWGQGTTVTVSS

SEQ ID NO: 222 - protein, 110 aa, Artificial Sequence
  Description of Artificial Sequence: Synthetic light chain variable region amino acid sequence
NFMLTQPHSVSASPGKTITISCTRSSGSIASNSVQWYQQRPGSAPTNVIYEDNQRPLGVPNRFSGSIDSSSNSASLTISGLKTEDEADYYCQSYHSSDQVFGGGTKVTVL

SEQ ID NO: 223 - protein, 121 aa, Artificial Sequence
  Description of Artificial Sequence: Synthetic heavy chain variable region amino acid sequence
QVQLVQSGAEVKEPGASVKVSCKASGYTFTNYGISWVRQAPGQGLEWLGWISAYNGNIHYAQKVQGRVTMTTDTSTSTGFMELRSLRSDDTAVYYCAREPPVIAAGDFQHWGQGTLVTVSS

SEQ ID NO: 224 - protein, 112 aa, Artificial Sequence
  Description of Artificial Sequence: Synthetic light chain variable region amino acid sequence
ETTLTQSPLSLPVTLGQPASISCRSSQSLVHSNGNTYLSWFQQRPGQSPRRLIYRVSNRDSGVPDRFSGSGSGTDFTLKISRVEAEDVGLYYCMQGTHWPPDFGQGTRLEIK

SEQ ID NO: 225 - protein, 131 aa, Artificial Sequence
  Description of Artificial Sequence: Synthetic heavy chain variable region amino acid sequence
QVQLVQSGAEVKKPGASVKVSCKASGFTFTNYGTSYGITWVRQAPGQGLEWMGWINTSNGNPNYAQKLQGRVTMTADTSTSTAYMELRSLISDDTAVYYCARGHRMVRGVVPTGYYGLDVWGQGTTVTVSS

SEQ ID NO: 226 - protein, 107 aa, Artificial Sequence
  Description of Artificial Sequence: Synthetic light chain variable region amino acid sequence
DIQLTQSPSSLSASVGDRVTITCRASQSISSYLNWYQQKPGKAPKLLIFAASNLQSGVPSRFSGSGSGTDFTLTISSLQPEDFATYYCQQSYITPWTFGQGTKVEIK

SEQ ID NO: 227 - protein, 121 aa, Artificial Sequence
  Description of Artificial Sequence: Synthetic heavy chain variable region amino acid sequence
QVQLVQSGAEVKKPGASVKVSCKASGYTFANYGIGWVRQAPGQGLEWMGWISAYNGKTNYAQKFQGRVTMTTDTSTSTAYMELRSLRSDDTAVYYCAREPPVIAAGDFPHWGQGTLVTVSS

SEQ ID NO: 228 - protein, 112 aa, Artificial Sequence
  Description of Artificial Sequence: Synthetic light chain variable region amino acid sequence
ETTLTQSPLSLPVTLGQPASISCRSSQSLEHSDLNTYLSWFQQRPGQSPRRLIYKVSNRDSGVPDRFSGSGSGTDFTLRISRVEAEDVGVYYCMQGTHWPPDFGQGTRLEIK

SEQ ID NO: 229 - protein, 125 aa, Artificial Sequence
  Description of Artificial Sequence: Synthetic heavy chain variable region amino acid sequence
QVQLVQSGGGLVKPGGSLRLSCAASGFTFSDYYMSWIRQAPGKGLEWVSYISSSSSYTNYADSVKGRFTISRDNAKNSLYLQMNSLRAEDTAVYYCAKRTEYCSSTGCAYYFDYWGQGTLVTVSS

SEQ ID NO: 230 - protein, 111 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKVTVL

SEQ ID NO: 231 - protein, 119 aa, Artificial Sequence
  Description of Artificial Sequence: Synthetic heavy chain variable region amino acid sequence
EVQLLESGGGLVKPGGSLRLSCAASGFTLTSYSMNWVRQAPGKGLEWVSSISSSSSYIHYADSVKGRFTISRDNAKNSLYLQMNSLRAEDTAVYYCAGSSLYPPFFDYWGQGTLVTVSS

SEQ ID NO: 232 - protein, 111 aa, Artificial Sequence
  Description of Artificial Sequence: Synthetic light chain variable region amino acid sequence
QSVVTQPPSVSGAPGQRVTISCTGSSSNLGAGYDVHWYQQLPGTAPKLLIYGNNNRPSGVPDRFSGSKSGTSASLAITGLQAEDEADYYCQSYDSSLSSVVFGGGTKLTVL

SEQ ID NO: 233 - protein, 118 aa, Artificial Sequence
  Description of Artificial Sequence: Synthetic heavy chain variable region amino acid sequence
QVQLVQSGAEVKKPGASVKVSCKVSGDTLTELSIHWVRQAPGKGHEWMGYFDHEDGEIMYAQKFQGRVTMTGDTSTDTAYMELSSLRSEDTAVYYCATVAAAGQFDYWGQGTLVTVSS

SEQ ID NO: 234 - protein, 107 aa, Artificial Sequence
  Description of Artificial Sequence: Synthetic light chain variable region amino acid sequence
DIQLTQSPSSLSASVGDRVTITCRARQSISTYLNWYQQKPGKAPKLLIYAASSLQSGVPSRFSGSGSGTDFTLTISSLQPEDFATYYCQQSYSSPYTFGQGTKVDIK

SEQ ID NO: 235 - protein, 126 aa, Artificial Sequence
  Description of Artificial Sequence: Synthetic heavy chain variable region amino acid sequence
QITLKESGPVLVKPSETLTLTCTVSGFSLSNAKMGVSWIRQPPGKALEWLAHIFSNDEKSYNTSLKNRLTISKDTSKSQVVLTMTNMDTVDTATYYCARINYYDSSGYYLANFDYWGQGTLVTVSS

SEQ ID NO: 236 - protein, 113 aa, Artificial Sequence
  Description of Artificial Sequence: Synthetic light chain variable region amino acid sequence
NIRLTQSPSSLSASVGDRVTITCRASQRIASYLNWYQQKPGHAPKLLIHAASSLQSGVPSRFSGSGSGTDFTLTINSLLPEDFATYYCQQSYSSPPHSSPPLTFGGGTKVEIK

SEQ ID NO: 237 - protein, 122 aa, Artificial Sequence
  Description of Artificial Sequence: Synthetic heavy chain variable region amino acid sequence
EVQLVESGAEVKKPGESLKISCKGSGYSFATYWIGWVRQMPGKGLEWMGIIYPGDSDTRYSPSFQGQVTISADKSISTAYLQWSSLKASDTAIYYCARAKLPVAGLYYFDYWGQGTLVTVSS

SEQ ID NO: 238 - protein, 106 aa, Artificial Sequence
  Description of Artificial Sequence: Synthetic light chain variable region amino acid sequence
DIQLTQSPSSLSASVGDRVTITCRASQGISSTLAWYQQKPGKAPKLLIYDASSLESGVPSRFSGSGSGTDFTLTISSLHPEDFATYYCQQFNTYPTFGGGTKVEIK

SEQ ID NO: 239 - protein, 127 aa, Artificial Sequence
  Description of Artificial Sequence: Synthetic heavy chain variable region amino acid sequence
QVQLVQSGAEVKKPGESLRISCTGSGYTFTNYWISWVRQMPGKGLEWMGRIDPTDSYTNYSPSFQGHVTISADKSISTAYLQSSSLKASDTATYYCARHRRLVPAAMSRGYYGMDVWGQGTTVTVSS

SEQ ID NO: 240 - protein, 107 aa, Artificial Sequence
  Description of Artificial Sequence: Synthetic light chain variable region amino acid sequence
EIVMTQSPSSLSASVGDRATITCRASQSISSYLNWYQQKPGKAPKLLIYAASNLQSGAPSRFSGSGSGTDFTLTISSLQPEDFATYFCQQTYSTPYTFGQGTKVEIK

SEQ ID NO: 241 - protein, 118 aa, Artificial Sequence
  Description of Artificial Sequence: Synthetic heavy chain variable region amino acid sequence
QVQLVQSGAEVKKPGESLKISCKGSGYTFTNYWIGWVRQMPGKGLEWMGIIYPDDSDTRYSPSFQGQVTISVDKSINTAYLQWSSLRASDTAIYYCACSNWPHYFDSWGQGTLVTVSS

SEQ ID NO: 242 - protein, 110 aa, Artificial Sequence
  Description of Artificial Sequence: Synthetic light chain variable region amino acid sequence
NFMLTQPHSVSESPGKTVTISCTRSSGNIAGNYVQWYQQRPGSAPTTVIYEDNQRPSGVPDRFSGSIDSSSNSASLTISGLKTEDEAVYYCQSYHPGNWVFGGGTKLTVL

SEQ ID NO: 243 - protein, 120 aa, Artificial Sequence
  Description of Artificial Sequence: Synthetic heavy chain variable region amino acid sequence
QVQLVQSGAEVKKPGESLKISCKGSGYSFSSYWVAWVRQMPGKGLEWMGIIYPADSDTRYSPSFQGQVTISADKSDSTAYLQWGSLKASDTAMYYCARSLYGSGDYFDYWGQGTLVTVSS

SEQ ID NO: 244 - protein, 110 aa, Artificial Sequence
  Description of Artificial Sequence: Synthetic light chain variable region amino acid sequence
NFMLTQPHSVSESPGRTVIISCTRSSGSIATNYVQWYQQRPGSAPTTVIYEDNQRPSGVPDRFSGSIDSSSNSASLTISGLKTEDEADYYCQSYGSGDVVFGGGTKVTVL

SEQ ID NO: 245 - protein, 120 aa, Artificial Sequence
  Description of Artificial Sequence: Synthetic heavy chain variable region amino acid sequence
QVQLVQSGAEVKKPGASVKLSCKASGYTFTTYTINWVRQAPGQGLEWMGWISGYNGNTDYAQKLQGRFTMTTDTSTNTAYMELRSLTSDDTAVYYCAKGGGGSESYFDYWGQGTLVTVSS

SEQ ID NO: 246 - protein, 109 aa, Artificial Sequence
  Description of Artificial Sequence: Synthetic light chain variable region amino acid sequence
SYELTQPPSVSVAPGKTARISCGGNNIGSKSVHWYQQKPGQAPVLVIYYDRDRPSGIPERFSGSNSGNTATLTISRVEAGDEADYYCQLWDRSSDHPYVFGTGTKVTVL

SEQ ID NO: 247 - protein, 120 aa, Artificial Sequence
  Description of Artificial Sequence: Synthetic heavy chain variable region amino acid sequence
EVQLLESGGGLVQPGGSLRLSCAASGFTFSIYSMNWVRQAPGKGLEWISYISRSGSTIFYADSVKGRFTISRDDAKNSLFLQMTSLRDADTAVYYCARVDCSNNKCYDYWGQGTLVTVSS

SEQ ID NO: 248 - protein, 108 aa, Artificial Sequence
  Description of Artificial Sequence: Synthetic light chain variable region amino acid sequence
DIQLTQSPATLSLSPGERATLSCRASQSISSFLAWYQQKPGQAPRLLIYDASKRATGTPARFSGGGSGRDFTLTISSLEPEDFAVYYCQQRSSWPLYTFGQGTKVEIK

SEQ ID NO: 249 - protein, 123 aa, Artificial Sequence
  Description of Artificial Sequence: Synthetic heavy chain variable region amino acid sequence
EVQLVESGGVVVQPGGSLRLSCAVSGFNFDDYSMHWVRQLPGKGLEWVSLISWDGGITYYADSVKGRFTISRDNSKNSLYLQMNSLRTEDTALYYCAKDGNRYSDNDYYFDYWGQGTLVTVSS

SEQ ID NO: 250 - protein, 107 aa, Artificial Sequence
  Description of Artificial Sequence: Synthetic light chain variable region amino acid sequence
DIRLTQSPGTLSLSPGERATLSCRASQGVSSSYLAWYQQKPGQAPRLLIYGASSRATGIPDRFSGSGSGTDFTLTISRLEPEDFAVYYCQQYGSSPLFGPGTKVEIK

SEQ ID NO: 251 - protein, 128 aa, Artificial Sequence
  Description of Artificial Sequence: Synthetic heavy chain variable region amino acid sequence
QVQLVQSGAEVKKPGSSVKVSCKASGGTFSSYAIYWVRQAPGQGLECMGGIIPIFGSANYAQKFQGRVTITADESTSTAYMELSSLRSEDTAVYYCATDSLKTTYYYGSSGYFRDHVWGQGTTVTVSS

SEQ ID NO: 252 - protein, 108 aa, Artificial Sequence
  Description of Artificial Sequence: Synthetic light chain variable region amino acid sequence
ETTLTQSPSSLSASVGDRVTITCRASQGISNYLAWYQQKPGKVPKLLIFAASTLQSGVPSRFSGSGSGTDFTLTISSLQPEDVATYYCQNFNSVLSFTFGPGTKVDIK

SEQ ID NO: 253 - protein, 117 aa, Artificial Sequence
  Description of Artificial Sequence: Synthetic heavy chain variable region amino acid sequence
EVQLVESGGGLVQPGRSLRLSCKTSGFTFGDYAMSWVRQAPGQGLDWVGFIRTKAYGGTTEYAASVKGRFTLSRDDSKSIAYLQMNSLKTEDTAVYYCKSGGQFDYWGRGTLVTVSS

SEQ ID NO: 254 - protein, 111 aa, Artificial Sequence
  Description of Artificial Sequence: Synthetic light chain variable region amino acid sequence
NFMLTQPHSVSGSPGKTVTISCTGSSGSIASNYVQWYQQRPGSAPTTVICEDNQRPSGVPDRFSGSIDSSSNSASLTISGLKTEDEADYYCQSYDRSNQEVFGGGTKLTVL

SEQ ID NO: 255 - protein, 123 aa, Artificial Sequence
  Description of Artificial Sequence: Synthetic heavy chain variable region amino acid sequence
QVQLVQSGGGLVKPGGSLRLSCAASGFSFSDYYMNWIRQAPGKGLEWVSYISSSSSYTNYADSVKGRFTISRDNAKKSLYLQMNSLRAEDTAVYYCASQTYSDYARGGAFDIWGQGTTVTVSS

SEQ ID NO: 256 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNNNRPSGVPDRFSGSKSGTSASLAITGLQAEDEADYYCQSYDSSLSGSVFGTGTKVTVL

SEQ ID NO: 257 - protein, 122 aa, Artificial Sequence
  Description of Artificial Sequence: Synthetic heavy chain variable region amino acid sequence
EVQLLESGGGLVQPGGSLRLSCAASGFTFSSYAMNWVRQAPGKGLEWVSTISGSGSSTYYADSVEGRFTISRDNSKNTLYLQMNSLRAEDTAIYYCAKEPRDMYIQQWLDSWGQGTLVTVSS

SEQ ID NO: 258 - protein, 107 aa, Artificial Sequence
  Description of Artificial Sequence: Synthetic light chain variable region amino acid sequence
GIRLTQSPSSVSASVGDRVIITCRASQGIRSWLAWYQQKPGKAPKLLIYAASRLQSGVPSRFSGSGSETDFTLTISSLQPEDFASYYCQQANSFPLTFGGGTKVEIK

SEQ ID NO: 259 - protein, 129 aa, Artificial Sequence
  Description of Artificial Sequence: Synthetic heavy chain variable region amino acid sequence
EVQLVESGGGVVQPGGSLRLSCAASGFSFSSCGMHWVRQVSGKGLEWVAFIRYDGSNKFYADSVKGRFTISRDNSKNTLYLQMNSLRVEDTAVYYCAKGGLEDVSTGYSPHYYYGMDVWGQGTTVTVSS

SEQ ID NO: 260 - protein, 106 aa, Artificial Sequence
  Description of Artificial Sequence: Synthetic light chain variable region amino acid sequence
QPVLTQPPSVSVSPGQTASITCSGDKLAYKYTCWYQQKPGQSPVLVIFQDSKRPSGIPERFSGSNSGNTATLTISGTQALDEADYYCQAWDSSTVVFGGGTKLTVL

SEQ ID NO: 261 - protein, 119 aa, Artificial Sequence
  Description of Artificial Sequence: Synthetic heavy chain variable region amino acid sequence
QVQLVQSGAEVKKPGESLKISCKGSGYTFTNYWIGWVRQMPGKGLEWMGIIYPGDSDTRYSPSFQGQVTISADKSITTAYLQWRVLKASDTAMYYCATMRGSSSHFHHWGQGTLVTVSS

SEQ ID NO: 262 - protein, 107 aa, Artificial Sequence
  Description of Artificial Sequence: Synthetic light chain variable region amino acid sequence
DIQVTQSPSSLSASVGDRVTITCRAGQGIGNYLAWYQQKPGKVPKVLIYAASTLQSGVPSRFSGSGSGTEFTLTISSLQPEDVATYYCQKYNNAPYAFGQGTRLEIK

SEQ ID NO: 263 - protein, 127 aa, Artificial Sequence
  Description of Artificial Sequence: Synthetic heavy chain variable region amino acid sequence
EVQLLESGGGLVQPGGSLRLSCSASGFTFNNYVMHWVRQAPGKGLEDASAISSNGVSTNYADSVKGRFTISRDNSKNTLYLQMRSLRAEDTALYYCVRDLIPHDSSAYYGYHGMDVWGQGTTVTVSS

SEQ ID NO: 264 - protein, 110 aa, Artificial Sequence
  Description of Artificial Sequence: Synthetic light chain variable region amino acid sequence
QPVLTQPPSASGTPGQSVTISCSGSSSNIGTNVVNWYQQLPGTAPKLLIYSNDLRPSGVPDRFSGSKSGTSASLAISGLQSEDEANYYCAAWDDSLNGVLFGGGTKLTVL

SEQ ID NO: 265 - protein, 122 aa, Artificial Sequence
  Description of Artificial Sequence: Synthetic heavy chain variable region amino acid sequence
EVQLLESGPALVKPTQTLTLTCTFSGFSLTTSGMCVSWIRQPPGKALEWLARIDWDDDQYFSTSLRTRLSISKDTSKNQVVLTMTNMDPVDTATYYCARSALNIAARGFDIWGQGTTVTVSS

SEQ ID NO: 266 - protein, 106 aa, Artificial Sequence
  Description of Artificial Sequence: Synthetic light chain variable region amino acid sequence
QPGLTQPPSVSVSPGQTARITCSGDVLPKHFSYWYQQKPGQAPVLVIHRDSERPSGIPERFSGSSSGTTVTLTISGVQAEDEADYYCQFSDITNTVFGGGTKLTVL

SEQ ID NO: 267 - protein, 118 aa, Artificial Sequence
  Description of Artificial Sequence: Synthetic heavy chain variable region amino acid sequence
QVQLVQSGGGLVQPGGSLRLSCAASGFTVSSNYMGWVRQAPGKGLEWVSVIYTGGSTYYADSVKGRFTISRDNFKNTLYLQMNSLRAEDTALYYCARDLYSSGWFGYWGQGTLVTVSS

SEQ ID NO: 268 - protein, 107 aa, Artificial Sequence
  Description of Artificial Sequence: Synthetic light chain variable region amino acid sequence
DIRLTQSPATLSVSPGERATLSCRASQSVSINLGWFQQKPGQSPRLLIYGTSTRATGIPARFSGSGSGTEFTLTISSLQSEDFAVYYCHQYNNWPYTFGQGTKVEIK

SEQ ID NO: 269 - protein, 120 aa, Artificial Sequence
  Description of Artificial Sequence: Synthetic heavy chain variable region amino acid sequence
EVQLLESGGGVVQSGRSLRLSCAASGFTFNNYAMHWVRQAPGKGLEWVAVISFDGGNKFYGDSVQGRFTISRDNSKNTLYLQTNSLRPEDTAVYYCARDRWEIQIGLDIWGQGTTVTVSS

SEQ ID NO: 270 - protein, 107 aa, Artificial Sequence
  Description of Artificial Sequence: Synthetic light chain variable region amino acid sequence
SYVLTQPPSVSVSPGQTARITCSGDALARQNAYWYQQKPGQAPVLVMYRDTGRPSGIPERFSGSSSGTTVTLTISEVQAEDEADYYCQSADSSGAYVFGTGTKVTVL

SEQ ID NO: 271 - protein, 122 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARVGWGYSYGYWFDPWGQGTLVTVSS

SEQ ID NO: 272 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVL

SEQ ID NO: 273 - protein, 122 aa, Artificial Sequence
  Description of Artificial Sequence: Synthetic heavy chain variable region amino acid sequence
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDIHHVLRFLDPDYWGQGTLVTVSS

SEQ ID NO: 274 - protein, 110 aa, Artificial Sequence
  Description of Artificial Sequence: Synthetic light chain variable region amino acid sequence
QSVLIQPASVSGFPGQSITISCTGTSSDVGGYNYVSWYQQHPGKAPKLMIYEVSNRPSGVSNRFSGSKSGNTASLTISGLQAEDEADYYCSSYTSSSTLVFGGGTKLTVL

SEQ ID NO: 275 - protein, 121 aa, Artificial Sequence
  Description of Artificial Sequence: Synthetic heavy chain variable region amino acid sequence
EVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKEGYNWNDYYFDYWGQGTLVTVSS

SEQ ID NO: 276 - protein, 108 aa, Artificial Sequence
  Description of Artificial Sequence: Synthetic light chain variable region amino acid sequence
QPVLTQPPSVSVAPGKTARITCGGNNIGSKSVHWYQQKPGQAPVLVVYDDSDRPSGIPERFSGSNSGNTATLTISRVEAGDEADYYCQVWDSSSDHWVFGGGTKLTVL

SEQ ID NO: 277 - protein, 120 aa, Artificial Sequence
  Description of Artificial Sequence: Synthetic heavy chain variable region amino acid sequence
EVQLLESGGGLVQPGGSLRLSCAASGFTVSSNYMSWVRQAPGKGLEWVSDIYSGGRTDYADSVKGRFTISRDNSKNTLDLQMNSLRAEDTAVYYCARETLGMDHWYFDLWGRGTLVTVSS

SEQ ID NO: 278 - protein, 108 aa, Artificial Sequence
  Description of Artificial Sequence: Synthetic light chain variable region amino acid sequence
QPGLTQPPSVSVAPGKTARITCGGNNIGSKSVHWYQQKPGQAPVLVVYDDSDRPSGIPERFSGSNSGNTATLTISRVEAGDEADYYCQVWDSTSDHPVFGGGTKLTVL

SEQ ID NO: 279 - protein, 122 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARLGYCSGGSCHFDYWGQGTLVTVSS

SEQ ID NO: 280 - protein, 112 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGFYVFGTGTKLTVL

SEQ ID NO: 281 - protein, 122 aa, Artificial Sequence
  Description of Artificial Sequence: Synthetic heavy chain variable region amino acid sequence
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGNEELGTGSNWFDPWGQGTLVTVSS

SEQ ID NO: 282 - protein, 106 aa, Artificial Sequence
  Description of Artificial Sequence: Synthetic light chain variable region amino acid sequence
SYVLTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 283 - protein, 122 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSFISYADSVKGRFTISRDSAKNSLYLQMNSLRAEDTAVYYCARDHPNWNGLAYFDYWGQGTLVTVSS

SEQ ID NO: 284 - protein, 111 aa, Artificial Sequence
  Description of Artificial Sequence: Synthetic light chain variable region amino acid sequence
QSVLTQPPSISGAPGQRVTISCTGSSSNIGAGYDVQWHQQLPGTAPKLLIYGNSNRPSGVPDRFSGSKSGTSASLAITGLQAEDEADYYCQSYDSSLSGWVFGGGTKLTVL

SEQ ID NO: 285 - protein, 124 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARDSCSGGSCYSPRFDPWGQGTLVTVSS

SEQ ID NO: 286 - protein, 108 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSTVVFGGGTKLTVL

SEQ ID NO: 287 - protein, 129 aa, Artificial Sequence
  Description of Artificial Sequence: Synthetic heavy chain variable region amino acid sequence
EVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARTPLYSYGRVVGFYYYGMDVWGQGTTVTVSS

SEQ ID NO: 288 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVL

SEQ ID NO: 289 - protein, 126 aa, Artificial Sequence
  Description of Artificial Sequence: Synthetic heavy chain variable region amino acid sequence
QVQLVQSGAEVKKPGSSVKVSCKASGGTFSSYTISWVRQAPGQGLEWMGRIIPILGIANYAQKFQGRVTITADKSTSTAYMELSSLRSEDTAVYYCARDGGPYYYDSSGYYRLDYWGQGTLVTVSS

SEQ ID NO: 290 - protein, 112 aa, Artificial Sequence
  Description of Artificial Sequence: Synthetic light chain variable region amino acid sequence
DIRMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWTYTFGQGTKLEIK

SEQ ID NO: 291 - protein, 122 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARELYDYVWGSYRDYWGQGTLVTVSS

SEQ ID NO: 292 - protein, 111 aa, Artificial Sequence
  Description of Artificial Sequence: Synthetic light chain variable region amino acid sequence
QPGLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKVTVL

SEQ ID NO: 293 - protein, 125 aa, Artificial Sequence
  Description of Artificial Sequence: Synthetic heavy chain variable region amino acid sequence
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATEREEGGYSGYDDAFDIWGQGTMVTVSS

SEQ ID NO: 294 - protein, 107 aa, Artificial Sequence
  Description of Artificial Sequence: Synthetic light chain variable region amino acid sequence
DIRMTQSPSTLSASVGDRVTITCRASQSISSWLAWYQQKPGKAPKLLIYKASSLESGVPSRFSGSGSGTEFTLTISSLQPDDFATYYCQQYNSYSYTFGQGTKLEIK

SEQ ID NO: 295 - protein, 121 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAPPSVGGWYFDLWGRGTLVTVSS

SEQ ID NO: 296 - protein, 108 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLVFGGGTKLTVL

SEQ ID NO: 297 - protein, 119 aa, Artificial Sequence
  Description of Artificial Sequence: Synthetic heavy chain variable region amino acid sequence
QVQLQESGPGLVKPSQTLSLTCTVSGGSISSGSYYWSWIRQPAGKGLEWIGRIYTSGSTNYNPSLKSRVTISVDTSKNQFSLKLSSVTAADTAVYYCAREGRGGAFDIWGQGTLVTVSS

SEQ ID NO: 298 - protein, 108 aa, Artificial Sequence
  Description of Artificial Sequence: Synthetic light chain variable region amino acid sequence
SYELTQPPSVSVSPGQTARITCSADALPKQYAYWYQQKPGQAPVLVIYKDSERPSGIPERFSGSSSGTTVTLTISGVQAEDEADYYCQSADSSGTYVVFGGGTQLTVL

SEQ ID NO: 299 - protein, 124 aa, Artificial Sequence
  Description of Artificial Sequence: Synthetic heavy chain variable region amino acid sequence
QVQLVQSGPGLVKPSETLSLTCTVSGGSISSSSYYWGWIRQPPGKGLEWIGSIYYSGSTYYNPSLKSRVTISVDTSKNQFSLKLSSVTAADTAVYYCARSLMNYSNYVLGFDPWGQGTLVTVSS

SEQ ID NO: 300 - protein, 106 aa, Artificial Sequence
  Description of Artificial Sequence: Synthetic light chain variable region amino acid sequence
QPVLTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 301 - protein, 121 aa, Artificial Sequence
  Description of Artificial Sequence: Synthetic heavy chain variable region amino acid sequence
EVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDGIAAAGTLFDYWGQGTLVTVSS

SEQ ID NO: 302 - protein, 107 aa, Artificial Sequence
  Description of Artificial Sequence: Synthetic light chain variable region amino acid sequence
DIQLTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 303 - protein, 118 aa, Artificial Sequence
  Description of Artificial Sequence: Synthetic heavy chain variable region amino acid sequence
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKYSNYGSFDYWGQGTLVTVSS

SEQ ID NO: 304 - protein, 106 aa, Artificial Sequence
  Description of Artificial Sequence: Synthetic light chain variable region amino acid sequence
DIQMTQSPSTLSASVGDRVTITCRASQSISSWLAWYQQKPGKAPKLLIYKASSLESGVPSRFSGSGSGTEFTLTISSLQPDDFATYYCQQYNSYSTFGQGTKVEIK

SEQ ID NO: 305 - protein, 122 aa, Artificial Sequence
  Description of Artificial Sequence: Synthetic heavy chain variable region amino acid sequence
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCAREGYSGSYGYYFDYWGQGTLVTVSS

SEQ ID NO: 306 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKLTVL

SEQ ID NO: 307 - protein, 122 aa, Artificial Sequence
  Description of Artificial Sequence: Synthetic heavy chain variable region amino acid sequence
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGPLTGYSSSWFDPWGQGTLVTVSS

SEQ ID NO: 308 - protein, 108 aa, Artificial Sequence
  Description of Artificial Sequence: Synthetic light chain variable region amino acid sequence
EIVMTQSPSSLSASVGDRVTITCRASQSISSYLNWYQQKPGKAPKLLIYAASSLQSGVPSRFSGSGSGTDFTLTISSLQPEDFATYYCQQSYSTLPYTFGQGTKVEIK

SEQ ID NO: 309 - protein, 120 aa, Artificial Sequence
  Description of Artificial Sequence: Synthetic heavy chain variable region amino acid sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDEALVGATFDYWGQGTLVTVSS

SEQ ID NO: 310 - protein, 113 aa, Artificial Sequence
  Description of Artificial Sequence: Synthetic light chain variable region amino acid sequence
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPRTFGQGTKVEIK

SEQ ID NO: 311 - protein, 124 aa, Artificial Sequence
  Description of Artificial Sequence: Synthetic heavy chain variable region amino acid sequence
EVQLVESGPGLVKPSGTLSLTCAVSGGSISSSNWWSWVRQPPGKGLEWIGEIYHSGSTNYNPSLKSRVTISVDKSKNQFSLKLSSVTAADTAVYYCARDVETDGYNYGYYFDYWGQGTLVTVSS

SEQ ID NO: 312 - protein, 108 aa, Artificial Sequence
  Description of Artificial Sequence: Synthetic light chain variable region amino acid sequence
SYELIQPPSVSVAPGKTARITCGGNNIGSKSVHWYQQKPGQAPVLVVYDDSDRPSGIPGRFSGSNSGNTATLTISRVEAGDEADYYCQVWDSSSDHKVFGGGTKLTVL

SEQ ID NO: 313 - protein, 120 aa, Artificial Sequence
  Description of Artificial Sequence: Synthetic heavy chain variable region amino acid sequence
QVQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARDRVVTTYFDYWGQGTLVTVSS

SEQ ID NO: 314 - protein, 108 aa, Artificial Sequence
  Description of Artificial Sequence: Synthetic light chain variable region amino acid sequence
SYELTQPPSVSVSPGQTARITCSGDALPKKYAYWYQQKSGQAPVLVIYEDSKRPSGIPERFSGSSSGTMATLTISGAQVEDEADYYCYSTDSSGNHRVFGGGTKLTVL

SEQ ID NO: 315 - protein, 123 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARELLDPGIAAAGFDYWGQGTLVTVSS

SEQ ID NO: 316 - protein, 112 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVNYVFGTGTKVTVL

SEQ ID NO: 317 - protein, 121 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDSGSYLSYAFDIWGQGTMVTVSS

SEQ ID NO: 318 - protein, 111 aa, Artificial Sequence
  Description of Artificial Sequence: Synthetic light chain variable region amino acid sequence
SYELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVL

SEQ ID NO: 319 - protein, 124 aa, Artificial Sequence
  Description of Artificial Sequence: Synthetic heavy chain variable region amino acid sequence
EVQLLESGGGLVQPGGSLRLSCAASGFTFSSYWMHWVRQAPGKGLVWVSRINSDGSSTSYADSVKGRFTISRDNAKNTLYLQMNSLRAEDTAVYYCARAPISILRFLGGYFDYWGQGTLVTVSS

SEQ ID NO: 320 - protein, 106 aa, Artificial Sequence
  Description of Artificial Sequence: Synthetic light chain variable region amino acid sequence
EIVMTQSPSTLSASVGDRVTITCRASQSISSWLAWYQQKPGKAPKLLIYKASSLESGVPSRFSGSGSGTEFTLTISSLQPDDFATYYCQQYNSYSSFGQGTKLEIK

SEQ ID NO: 321 - protein, 124 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARGYCSGGSCYSHYFQHWGQGTLVTVSS

SEQ ID NO: 322 - protein, 110 aa, Artificial Sequence
  Description of Artificial Sequence: Synthetic light chain variable region amino acid sequence
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKVTVL

SEQ ID NO: 323 - protein, 120 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARSQSGSYYSSDYWGQGTLVTVSS

SEQ ID NO: 324 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKVTVL

SEQ ID NO: 325 - protein, 123 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARQGYCSGGSCYHIDYWGQGTLVTVSS

SEQ ID NO: 326 - protein, 111 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVL

SEQ ID NO: 327 - protein, 123 aa, Artificial Sequence
  Description of Artificial Sequence: Synthetic heavy chain variable region amino acid sequence
EVQLVESGGGRVKPGGSLRLSCAASGFTFRSYSMNWVRQAPGKGLEWVSSISSSSSYINYADSVKGRFTISRDNAKNSLYLQMNSLRAEDTAVYYCARDGSGMTIFGVVIDYWGQGTLVTVSS

SEQ ID NO: 328 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDRSLTVVFGGGTKLTVL

SEQ ID NO: 329 - protein, 120 aa, Artificial Sequence
  Description of Artificial Sequence: Synthetic heavy chain variable region amino acid sequence
QVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCAREALGMDHWYFDLWGRGTLVTVSS

SEQ ID NO: 330 - protein, 108 aa, Artificial Sequence
  Description of Artificial Sequence: Synthetic light chain variable region amino acid sequence
SYELMQPPSVSVAPGKTARITCGGNNIGSKSVHWYQQKPGQAPVLVVYDDSDRPSGIPERFSGSNSGNTATLTISRVEAGDEADYYCQVWDSSSDHPVFGGGTKVTVL

SEQ ID NO: 331 - protein, 122 aa, Artificial Sequence
  Description of Artificial Sequence: Synthetic heavy chain variable region amino acid sequence
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGITAYYYYYGMDVWGQGTTVTVSS

SEQ ID NO: 332 - protein, 107 aa, Artificial Sequence; identical to SEQ ID NO: 54
  Description of Artificial Sequence: Synthetic light chain variable region amino acid sequence

SEQ ID NO: 333 - protein, 122 aa, Artificial Sequence
  Description of Artificial Sequence: Synthetic heavy chain variable region amino acid sequence
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCASSLTVTSRSDAFDIWGQGTMVTVSS

SEQ ID NO: 334 - protein, 108 aa, Artificial Sequence
  Description of Artificial Sequence: Synthetic light chain variable region amino acid sequence
QPGLTQLPSVSVAPGKTARITCGGNNIGSKSVHWYQQKPGQAPVLVVYDDSDRPSGIPERFSGSNSGNTATLTISRVEAGDEADYYCQVWDSSSDHVVFGGGTKLTVL

SEQ ID NO: 335 - protein, 120 aa, Artificial Sequence
  Description of Artificial Sequence: Synthetic heavy chain variable region amino acid sequence
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHAANWGYYFDYWGQGTLVTVSS

SEQ ID NO: 336 - protein, 106 aa, Artificial Sequence
  Description of Artificial Sequence: Synthetic light chain variable region amino acid sequence
DIVMTQSPSTLSASVGDRVTITCRASQSISSWLAWYQQKPGKAPKLLIYKASSLESGVPSRFSGSGSGTEFTLTISSLQPDDFATYYCQQYNSYWTFGQGTKVEIK

SEQ ID NO: 337 - protein, 118 aa, Artificial Sequence
  Description of Artificial Sequence: Synthetic heavy chain variable region amino acid sequence
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARDRLGIFDYWGQGTLVTVSS

SEQ ID NO: 338 - protein, 113 aa, Artificial Sequence
  Description of Artificial Sequence: Synthetic light chain variable region amino acid sequence
EIVLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 339 - protein, 120 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREGSSSWYYFDYWGQGTLVTVSS

SEQ ID NO: 340 - protein, 112 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGPWVFGGGTKLTVL

SEQ ID NO: 341 - protein, 122 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCASLSSSSELGYYFDYWGQGTLVTVSS

SEQ ID NO: 342 - protein, 111 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKLTVL

SEQ ID NO: 343 - protein, 121 aa, Artificial Sequence
  Description of Artificial Sequence: Synthetic heavy chain variable region amino acid sequence
EVQLVESGPGLVKPSETLSLTCTVSGGSISSSSYYWGWIRQPPGKGLEWIGSIYYSGSTYYNPSLKSRVTISVDTSKNQFSLKLSSVTAADTAVYYCARRDGYNYGWFDPWGQGTLVTVSS

SEQ ID NO: 344 - protein, 110 aa, Artificial Sequence
  Description of Artificial Sequence: Synthetic light chain variable region amino acid sequence
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNVVFGGGTKVTVL

SEQ ID NO: 345 - protein, 118 aa, Artificial Sequence
  Description of Artificial Sequence: Synthetic heavy chain variable region amino acid sequence
QVQLQESGPGLVKPSETLSLTCAVSGYSISSGYYWGWIRQPPGKGLEWIGSIYHSGSTYYNPSLKSRVTISVDTSKNQFSLKLSSVTAADTAVYYCARWTVMYYFDYWGQGTLVTVSS

SEQ ID NO: 346 - protein, 106 aa, Artificial Sequence
  Description of Artificial Sequence: Synthetic light chain variable region amino acid sequence
EIVMTQSPATLSLSPGERATLSCRASQSVSSYLAWYQQKPGQAPRLLIYDASNRATGIPARFSGSGSGTDFTLTISSLEPEDFAVYYCQQRSNWPTFGGGTKLEIK

SEQ ID NO: 347 - protein, 122 aa, Artificial Sequence
  Description of Artificial Sequence: Synthetic heavy chain variable region amino acid sequence
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKGRGDFWSGYGMDVWGQGTTVTVSS

SEQ ID NO: 348 - protein, 106 aa, Artificial Sequence
  Description of Artificial Sequence: Synthetic light chain variable region amino acid sequence
SYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKVTVL

SEQ ID NO: 349 - protein, 121 aa, Artificial Sequence
  Description of Artificial Sequence: Synthetic heavy chain variable region amino acid sequence
EVQLVESGGGLVQPGGSLRLSCSASGFTFSSYAMHWVRQAPGKGLEYVSAISSNGGSTYYADSVKGRFTISRDNSKNTLYLQMSSLRAEDTAVYYCVKADQGSSGWFPDYWGQGTLVTVSS

SEQ ID NO: 350 - protein, 110 aa, Artificial Sequence
  Description of Artificial Sequence: Synthetic light chain variable region amino acid sequence
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNWVFGGGTKLTVL

SEQ ID NO: 351 - protein, 118 aa, Artificial Sequence
  Description of Artificial Sequence: Synthetic heavy chain variable region amino acid sequence
EVQLVESGAEVKKPGESLKISCKGSGYSFTSYWIGWVRQMPGKGLEWMGIIYPGDSDTRYSPSFQGQVTISADKSISTAYLQWSSLKASDTAMYYCARLIAAAGIDYWGQGTLVTVSS

SEQ ID NO: 352 - protein, 111 aa, Artificial Sequence
  Description of Artificial Sequence: Synthetic light chain variable region amino acid sequence
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNIWVFGGGTKVTVL

SEQ ID NO: 353 - protein, 120 aa, Artificial Sequence
  Description of Artificial Sequence: Synthetic heavy chain variable region amino acid sequence
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARPYSGSYYAFDIWGQGTTVTVSS

SEQ ID NO: 354 - protein, 110 aa, Artificial Sequence
  Description of Artificial Sequence: Synthetic light chain variable region amino acid sequence
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNQVFGGGTKLTVL

SEQ ID NO: 355 - protein, 121 aa, Artificial Sequence
  Description of Artificial Sequence: Synthetic heavy chain variable region amino acid sequence
EVQLLESGAEVKKPGASVKVTCKASGYTFTHFGINWVRQAPGQGLEWLGWISAYNGNTNYVQKIQGRVTMTTDTSTNTAYMELRSLRSDDTAVYYCARGPPVEAAGTFDYWGQGTLVTVSS

SEQ ID NO: 356 - protein, 112 aa, Artificial Sequence
  Description of Artificial Sequence: Synthetic light chain variable region amino acid sequence
DIVLTQSPLSLPVTLGQPASISCRSSQSLVYSDGNTYLTWFQQRPGQSPRRLIYKVSNRDSGVPDRFSGSGSGTDFTLQISRVEAEDVGVYYCMQGTHWPFTFGPGTKVEIK

SEQ ID NO: 357 - protein, 125 aa, Artificial Sequence
  Description of Artificial Sequence: Synthetic heavy chain variable region amino acid sequence
QVQLVESGPTLVKPTQTLTLTCTFSGFSLSTSRVGVGWIRQPPGKALEWLALIYWDDDKRYSPSLKSRLTITKDTSKNQVVLTMTNMDPVDTARYYCAHRSTYDILGGYYYFDYWGQGTLVTVSS

SEQ ID NO: 358 - protein, 109 aa, Artificial Sequence
  Description of Artificial Sequence: Synthetic light chain variable region amino acid sequence
QPVLTQPRSVSGSPGQSVTISCTGTSSDVGGYNYVSWFQQHPGKAPKLMIYDVSKRPSGVPNRFSGSKSGNTASLTISGLQAEDEADYFCCSYAGTYEVFGGGTKLTVL

SEQ ID NO: 359 - protein, 120 aa, Artificial Sequence
  Description of Artificial Sequence: Synthetic heavy chain variable region amino acid sequence
QVQLVESGPGVVKPSETLSLTCTVSGGPVSSRSYYWGWIRQPPGKGLEWIGSIYYSGSTYYNTSLKSRVTISVDTSKNQFSLKLSSVTAADTAVYYCAKLQYSTSGFDYWGQGTLVTVSS

SEQ ID NO: 360 - protein, 110 aa, Artificial Sequence
  Description of Artificial Sequence: Synthetic light chain variable region amino acid sequence
QPVLTQPPSVSEAPRQRVTISCSGSSSNIGNNAVSWYQQLPGKAPKLLIYYDDLVPSGVSDRFSGSKSGTSASLAISGLQSEDEADYYCAAWDDSLNGVVFGGGTKLTVL

SEQ ID NO: 361 - protein, 119 aa, Artificial Sequence
  Description of Artificial Sequence: Synthetic heavy chain variable region amino acid sequence
QVQLVQSGAEVKKPGSSVKVSCKASGGTFSSNAINWVRQAPGQGLEWMGGIIPIFGTANYAQKFQGRVTITTDESTSTAYMELSSLRSEDTAVYYCATTFYYGSGADYWGQGTLVTVSS

SEQ ID NO: 362 - protein, 111 aa, Artificial Sequence
  Description of Artificial Sequence: Synthetic light chain variable region amino acid sequence
DIQMTQSPLSLPVTLGQPASISCRSSQSLVYSDGNMYLSWFQQRPGQSPRRLIYKVSNRDSGVPDRFSGSGSGTDFTLKISRVEAEDVGVYYCMQGTHWWTFGQGTKVEIK

SEQ ID NO: 363 - protein, 124 aa, Artificial Sequence
  Description of Artificial Sequence: Synthetic heavy chain variable region amino acid sequence
EVQLVESGGGLVKPGGSLRLSCAASGFTFSAYSMNWVRQAPGKGLEWVSSISSTTNYISYADSVKGRFTISRDNAKNSLYLQMNSLRAEDTAVYYCARDPKYYGLGTYYKDDYWGQGTLVTVSS

SEQ ID NO: 364 - protein, 111 aa, Artificial Sequence
  Description of Artificial Sequence: Synthetic light chain variable region amino acid sequence
NFMLTQPHSVSESPGKTVTISCTRSGGSIASNYVQWYQQRPGSSPTTVIYEDNQRPSGVPDRFSGSIDSSFNSASLTVSGLKTEDEADYYCQSFDNNNRWVFGGGTKLTVL

SEQ ID NO: 365 - protein, 123 aa, Artificial Sequence
  Description of Artificial Sequence: Synthetic heavy chain variable region amino acid sequence
EVQLVESGGVVVQPGGSLRLSCAASGFTFDDYTMHWVRQAPGKGLEWVSLISWDGGITYYADSVKGRFTISRDNSKNSLYLQMNSLRTEDTALYYCVKGGYYDGSGYYYFDYWGQGTLVTVSS

SEQ ID NO: 366 - protein, 107 aa, Artificial Sequence
  Description of Artificial Sequence: Synthetic light chain variable region amino acid sequence
DIQMTQSPSSLSASVGDRVTVTCRASQSISSYLNWYQHKPGNAPKLLIYAASSLQSGVPSRFSGSGSGTDFTLTISSLQPEDFATYYCQQSYSTPYTFGQGTKVEIK

SEQ ID NO: 367 - protein, 117 aa, Artificial Sequence
  Description of Artificial Sequence: Synthetic heavy chain variable region amino acid sequence
QVQLQQWGAGLLKPSETLSLTCGAFHGSFSGYYWSWIRQPPGKGLEWIGEVTHSRSTNYNPSLKSRITISVDTSRNQFSLKLNSVTAADTAVYYCARGSGEWYFDIWGRGTLVTVSS

SEQ ID NO: 368 - protein, 108 aa, Artificial Sequence
  Description of Artificial Sequence: Synthetic light chain variable region amino acid sequence
DIQLTQSPSTLSASVGDRVTITCRASQSISSWLAWYQQKPGRAPKLLIYKASSLESGVPSRFSGSGSGTEFTLTISSLQPDDFATYYCQQYNSYSPEIFGQGTKVEIK

SEQ ID NO: 369 - protein, 118 aa, Artificial Sequence
  Description of Artificial Sequence: Synthetic heavy chain variable region amino acid sequence
QVQLVQSGAEVKKPGESLKISCKGSGYSFTTYWIGWVRQMPGKGLEWMGIIFPGDSDTRYSPSFQGQVTISADKSISTAYLQWSSLKASDTAMYFCARSAFPFGFDIWGQGTMVTVSS

SEQ ID NO: 370 - protein, 111 aa, Artificial Sequence
  Description of Artificial Sequence: Synthetic light chain variable region amino acid sequence
SYVLTQPHSVSESPGKTVTISCTRSSGSIASNYVQWYQQRPGSSPTTVIYEDHQRPSGVPDRFSGSIDSSSNSASLTISGLQTEDEADYYCQSYGSGNPWVFGGGTKVTVL

SEQ ID NO: 371 - protein, 122 aa, Artificial Sequence
  Description of Artificial Sequence: Synthetic heavy chain variable region amino acid sequence
QVQLQESGSGLVKPSQTLSLTCVVSGGSISSGGNSWSWIRQPPGKGLEWIGYIYDSGNTYYNPSLKSRVTISVDRSKNQFSLKVSSVTAADTAVYYCARGAETGTTGWYDPWGQGTLVTVSS

SEQ ID NO: 372 - protein, 107 aa, Artificial Sequence
  Description of Artificial Sequence: Synthetic light chain variable region amino acid sequence
DIRLTQSPSSLSASVGDRVTITCRASQTISSYLNWYQQKPGKAPRLLIYAASSLQSGVPSRFSGSGSGTDFTLTISSLQPEDFATYYCQQSYGTPRTFGQGTKVEIK

SEQ ID NO: 373 - protein, 126 aa, Artificial Sequence
  Description of Artificial Sequence: Synthetic heavy chain variable region amino acid sequence
QVQLQESGPGLVKPSQTLSLSCTVSGGSISSTNYYWTWIRQHPGKGLEWIGFIYNRGSTYYNPSLTSRVTISVDTSKNQFSLKLTSVTAADTAVYYCARAPYYYDRNGYYTAFDIWGQGTTVTVSS

SEQ ID NO: 374 - protein, 107 aa, Artificial Sequence
  Description of Artificial Sequence: Synthetic light chain variable region amino acid sequence
EIVLTQSPATLSVSPGERATLSCRASQSVSSNLAWYQQKPGQAPRLLIYDASTRATDIPARFSGGGSGTEFTLTISSLQSEDFAVYYCQQYNNWPRTFGLGTKVDIK

SEQ ID NO: 375 - protein, 120 aa, Artificial Sequence
  Description of Artificial Sequence: Synthetic heavy chain variable region amino acid sequence
QVQLQESGPGLVKPSETLSLTCSVSGGSLTSYYWSWIRQPPGKGLEWIGYIYYSGSTNYNPSLKSRLTISVDTSKNQFSLKLSSVTAADTAVYYCARVGGRGVINVFDYWGQGTLVTVSS

SEQ ID NO: 376 - protein, 111 aa, Artificial Sequence
  Description of Artificial Sequence: Synthetic light chain variable region amino acid sequence
QPVLTQPASVSGSPGQSITISCTGTSSDVGGYNYVSWYQQHPGKAPKLMIYEVSNRPSGVSNRFSGSKSGNTASLTISGLQAEDEADYYCDSYRSNSASVVFGGGTKLTVL

SEQ ID NO: 377 - protein, 126 aa, Artificial Sequence
  Description of Artificial Sequence: Synthetic heavy chain variable region amino acid sequence
QVTLKESGPALVKPTQTLTLTCTFSGLSISTSGMCVSWIRQPPGKALEWLARIDWDDDKYYSTSLKTRLTISKDTSKNQVVLTMTNMDPVDTATYYCARINYYDSSGYYVYYFDYWGQGTLVTVSS

SEQ ID NO: 378 - protein, 108 aa, Artificial Sequence
  Description of Artificial Sequence: Synthetic light chain variable region amino acid sequence
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPFTFGPGTKVDIK

SEQ ID NO: 379 - protein, 124 aa, Artificial Sequence
  Description of Artificial Sequence: Synthetic heavy chain variable region amino acid sequence
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATARFLEWLSGTNWFDPWGQGTLVTVSS

SEQ ID NO: 380 - protein, 112 aa, Artificial Sequence
  Description of Artificial Sequence: Synthetic light chain variable region amino acid sequence
DIQLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPTFGGGTKVEIK

SEQ ID NO: 381 - protein, 124 aa, Artificial Sequence
  Description of Artificial Sequence: Synthetic heavy chain variable region amino acid sequence
QITLKESGPALVKPTQTLTLTCTFSGFSLSTSGMCVSWIRQPPGKALEWLARIDWDDDKYYSTSLKTRLTISKDTSKNQVVLTMTNMDPVDTATYYCARMCWGNYVPIDAFDIWGQGTMVTVSS

SEQ ID NO: 382 - protein, 107 aa, Artificial Sequence
  Description of Artificial Sequence: Synthetic light chain variable region amino acid sequence
DIQLTQSPSSLSASVGDRVTITCRASQGIRNDLGWYQQKPGKAPKRLIYAASSLQSGVPSRFSGSGSGTEFTLTISSLQPEDFATYYCLQHNSYPPTFGQGTKVDIK

SEQ ID NO: 383 - protein, 120 aa, Artificial Sequence
  Description of Artificial Sequence: Synthetic heavy chain variable region amino acid sequence
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDSSSGGMDVWGQGTTVTVSS

SEQ ID NO: 384 - protein, 112 aa, Artificial Sequence
  Description of Artificial Sequence: Synthetic light chain variable region amino acid sequence
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 385 - protein, 123 aa, Artificial Sequence
  Description of Artificial Sequence: Synthetic heavy chain variable region amino acid sequence
QVQLVQSGPTLVKPTQTLTLTCTFSGFSLSTSGVGVGWIRQPPGKALEWLALIYWDDDKRYSPSLKSRLTITKDTSKNQVVLTMTNMDPVDTATYYCAHRRATTVTTGYFDYWGQGTLVTVSS

SEQ ID NO: 386 - protein, 112 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGHYVFGTGTKVTVL

SEQ ID NO: 387 - protein, 118 aa, Artificial Sequence
  Description of Artificial Sequence: Synthetic heavy chain variable region amino acid sequence
QVQLVQSGAEVKKPGESLKISCKGSGYRFTSYWIGWVRQMPGKGLEWMGIIYPGDSDTRYSPSFQGQVTISADKSISTAYLQWSSLKASDTAMYYCARSGSHYAFDLWGQGTMVTVSS

SEQ ID NO: 388 - protein, 111 aa, Artificial Sequence
  Description of Artificial Sequence: Synthetic light chain variable region amino acid sequence
NFMLTQPHSVSESPGKTVTISCTRSSGNIASNYVQWYQQRPGSSPTTVLYEDNQRPSGVPDRFSGSIDSSSNSASLTISGLKTEDEADYYCQSYDSSNPWVFGGGTKLTVL

SEQ ID NO: 389 - protein, 122 aa, Artificial Sequence
  Description of Artificial Sequence: Synthetic heavy chain variable region amino acid sequence
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLIENTRVGEYYFDYWGQGTLVTVSS

SEQ ID NO: 390 - protein, 106 aa, Artificial Sequence
  Description of Artificial Sequence: Synthetic light chain variable region amino acid sequence
SYELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTQLTVL

SEQ ID NO: 391 - protein, 126 aa, Artificial Sequence
  Description of Artificial Sequence: Synthetic heavy chain variable region amino acid sequence
QVQLVQSGAEVKKPGSSVKVSCKASGGTFSSYVISWVRQAPGQGLEWMGGIIPIFGTTYYAQKFQDRVTITTDESTSTAYMELSSLRSEDTAVYYCARDLRYRYNAYDGADAFDIWGQGTTVTVSS

SEQ ID NO: 392 - protein, 110 aa, Artificial Sequence
  Description of Artificial Sequence: Synthetic light chain variable region amino acid sequence
QSALTQPASVSGSPGQSITISCTGTSSDVGGYNYVSWYQQHPGKAPKLMIFEVSNRPSGVSNRFSGSKSGNTASLTISGLQAEDEADYYCTSYTKSNSVVFGGGTKLTVL

SEQ ID NO: 393 - protein, 117 aa, Artificial Sequence
  Description of Artificial Sequence: Synthetic heavy chain variable region amino acid sequence
QVQLQESGPGLVKPSETLSLTCTVSGGSISSYYWSWIRQPPGKGLEWIGYIYTSGSTNYNPSLKSRVTISVDTSKNQFSLKLSSVTAADTAVYYCARVGSYYDLQHWGQGTLVTVSS

SEQ ID NO: 394 - protein, 107 aa, Artificial Sequence; identical to SEQ ID NO: 302
  Description of Artificial Sequence: Synthetic light chain variable region amino acid sequence

SEQ ID NO: 395 - protein, 124 aa, Artificial Sequence
  Description of Artificial Sequence: Synthetic heavy chain variable region amino acid sequence
EVQLVESGGGVVQPGGSLRLSCAASGFTFSSYGMHWVRQAPGKGLEWVAFIRYDGSNKYYADSVKGRFTISRDNSKSTLYLQMNSLRAEDTAVYYCAKDATFGYSSSWYNFDYWGQGTLVTVSS

SEQ ID NO: 396 - protein, 112 aa, Artificial Sequence
  Description of Artificial Sequence: Synthetic light chain variable region amino acid sequence
DIQMTQSPDSLAVSLGERATINCKSSQSVLFSSNNKNYLAWYQQKPGQPPKLLIYWASTRESGVPDRFSGSGSGTDFTLTISSLQAEDVAVYYCQQYYSTPTFGQGTKVEIK

SEQ ID NO: 397 - protein, 117 aa, Artificial Sequence
  Description of Artificial Sequence: Synthetic heavy chain variable region amino acid sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCSRGYSYGYDYWGQGTLVTVSS

SEQ ID NO: 398 - protein, 110 aa, Artificial Sequence; identical to SEQ ID NO: 350
  Description of Artificial Sequence: Synthetic light chain variable region amino acid sequence

SEQ ID NO: 399 - protein, 121 aa, Artificial Sequence
  Description of Artificial Sequence: Synthetic heavy chain variable region amino acid sequence
EVQLVESGGGLVQPGGSLRLSCAASGFTVSSNYMSWVRQAPGKGLEWVSVIYSGGSAYYADSVKGRFTISRDNSKNTLYLQMNSLRAEDTAVYYCAREARISPPQGAFDIWGQGTMVTVSS

SEQ ID NO: 400 - protein, 108 aa, Artificial Sequence
  Description of Artificial Sequence: Synthetic light chain variable region amino acid sequence
SYVLTQPPSVSVSPGQTARITCSGDALPKQYAYWYQQKPGQAPVLVIYKDSERPSGIPERFSGSSSGTTVTLTISGVQAEDEADYYCQSADSSGTLYVFGTGTKVTVL

SEQ ID NO: 401 - protein, 120 aa, Artificial Sequence
  Description of Artificial Sequence: Synthetic heavy chain variable region amino acid sequence
EVQLLESGPGLVKPSETLSLTCTVSGGSISSSSYYWGWIRQPPGKGLEWIGSIYYSGSTYYNPSLKSRVTISVDTSKNQFSLKLSSVTAADTAVYYCAVLLYSSSSFDYWGQGTLVTVSS

SEQ ID NO: 402 - protein, 111 aa, Artificial Sequence
  Description of Artificial Sequence: Synthetic light chain variable region amino acid sequence
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNQAVFGGGTQLTVL

SEQ ID NO: 403 - protein, 119 aa, Artificial Sequence
  Description of Artificial Sequence: Synthetic heavy chain variable region amino acid sequence
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARGNTVTTFLDYWGQGTLVTVSS

SEQ ID NO: 404 - protein, 108 aa, Artificial Sequence
  Description of Artificial Sequence: Synthetic light chain variable region amino acid sequence
DIRLTQSPSSFSASTGDRVTITCRASQGISSYLAWYQQKPGKAPKLLIYAASTLQSGVPSRFSGSGSGTDFTLTISCLQSEDFATYYCQQYYSYPPLTFGGGTKVDIK

SEQ ID NO: 405 - protein, 122 aa, Artificial Sequence
  Description of Artificial Sequence: Synthetic heavy chain variable region amino acid sequence
QVQLVQSGAEVKKPGASVKVSCKASGYAFTNYGVSWVRQAPGQGLEWMGWISVYNGNTNYAQKLQGRVTMTTDTSTSTAYMELRSLRSDDTALYYCARDPPSEGAAGLFDYWGQGTLVTISS

SEQ ID NO: 406 - protein, 112 aa, Artificial Sequence
  Description of Artificial Sequence: Synthetic light chain variable region amino acid sequence
DIVMTQSPLSLPVTLGQPASFSCRSSQSLVYSDGNTYLSWFQQRPGQSPRRLIYKVSNRDSGVPDRFSGSGSGTDFTLKISRVEAEDVGVYYCMQGTHWPCTFGQGTKVEIK

SEQ ID NO: 407 - protein, 124 aa, Artificial Sequence
  Description of Artificial Sequence: Synthetic heavy chain variable region amino acid sequence
EVQLVESGGGVVQPGGSLRLSCAASGFTFSSDGMHWVRQAPGKGLEWVAFIQYDGTNKYYVDSVKGRFTISRDNSKNTLYLQMNSLRAEDTAVYYCAKDQGFRYSSSWYAFDIWGQGTMVTVSS

SEQ ID NO: 408 - protein, 112 aa, Artificial Sequence
  Description of Artificial Sequence: Synthetic light chain variable region amino acid sequence
EIVMTQSPDSLAVSLGERATINCKSSQSVLFNSNNKNYLAWYQQKPGQPPKLLIYWASTRESGVPDRFSGSGSGTDFTLTISSLQAEDVAVYYCQQYYSTPTFGQGTRLEIK

SEQ ID NO: 409 - protein, 126 aa, Artificial Sequence
  Description of Artificial Sequence: Synthetic heavy chain variable region amino acid sequence
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDSLVNCSGGSCPGGPDYWGQGTLVTVSS

SEQ ID NO: 410 - protein, 108 aa, Artificial Sequence
  Description of Artificial Sequence: Synthetic light chain variable region amino acid sequence
SYVLTQPPSVSVSPGQTARITCSGDALPKKYAYWYQQKSGQAPVLVIYEDSKRPSGIPERFSGSSSGTMATLTISGAQVEDEADYYCYSTDSSGNHRVFGGGTKLTVL

SEQ ID NO: 411 - protein, 123 aa, Artificial Sequence
  Description of Artificial Sequence: Synthetic heavy chain variable region amino acid sequence
QVQLVQSGAEVKKPGESLKISCKGSGYSFTNYWIGWVRQMPGKGLEWMGITYPGDSDTRYSPSFQGQVTISADKSISTAHLQWDSLKASDTAMYYCARLRCTGSICYDAFDIWGQGTTVTVSS

SEQ ID NO: 412 - protein, 108 aa, Artificial Sequence
  Description of Artificial Sequence: Synthetic light chain variable region amino acid sequence
SYVLTQPLSVSVALGQTARITCGGNNIGSKNVHWYQQKPGQAPVLVIYRDNNRPSGIPERFSGSNSGNTATLTISRAQAGDEADYYCQVWDSSTGGDVFGAGTKVTVL

SEQ ID NO: 413 - protein, 128 aa, Artificial Sequence
  Description of Artificial Sequence: Synthetic heavy chain variable region amino acid sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVRSVGRFGELLYYYYGMDVWGQGTTVTVSS

SEQ ID NO: 414 - protein, 112 aa, Artificial Sequence
  Description of Artificial Sequence: Synthetic light chain variable region amino acid sequence
DIRLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKLEIK

SEQ ID NO: 415 - protein, 122 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREVLTGDYLGWFDPWGQGTLVTVSS

SEQ ID NO: 416 - protein, 109 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSHWVFGGGTKLTVL

SEQ ID NO: 417 - protein, 124 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCASSRRSLTGDRGGWFDPWGQGTLVTVSS

SEQ ID NO: 418 - protein, 111 aa, Artificial Sequence; identical to SEQ ID NO: 288
  Description of Artificial Sequence: Synthetic light chain variable region amino acid sequence

SEQ ID NO: 419 - protein, 122 aa, Artificial Sequence
  Description of Artificial Sequence: Synthetic heavy chain variable region amino acid sequence
EVQLVESGGGLVKPGGSLRLSCAASGFSLSSYYMNWVRQAPGKGLEWVSSISSSSTYINYADSVKGRFTISRDNAKNSLYLQMNSLRAEDTAVYYCARGGSITIFGVVFDSWGQGTLVTVSS

SEQ ID NO: 420 - protein, 111 aa, Artificial Sequence
  Description of Artificial Sequence: Synthetic light chain variable region amino acid sequence
SYELTQPPSVSGAPGQRVTISCTGTSSNIGAGYDVHWYQQLPGTAPKLLIYVNSNRPSGVPDRFSGSKSGTSASLAITGLQAEDEADYYCQSYDSSLSGGVFGTGTKVTVL

SEQ ID NO: 421 - protein, 128 aa, Artificial Sequence
  Description of Artificial Sequence: Synthetic heavy chain variable region amino acid sequence
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHSVYYDFWSGYYVPNYFDYWGQGTLVTVSS

SEQ ID NO: 422 - protein, 107 aa, Artificial Sequence
  Description of Artificial Sequence: Synthetic light chain variable region amino acid sequence
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 423 - protein, 121 aa, Artificial Sequence
  Description of Artificial Sequence: Synthetic heavy chain variable region amino acid sequence
EVQLLESGAEVKKPGASVKVSCKTSGYTFSNYGVSWVRQAPGQGLEWLGWISAYNGNTNYAQKLQGRVTMTTDSSTSTAYMEVRSLRSDDTAVYYCARDVAPVAASLFDYWGQGTLVTVSS

SEQ ID NO: 424 - protein, 112 aa, Artificial Sequence
  Description of Artificial Sequence: Synthetic light chain variable region amino acid sequence
DIRLTQSPLSLPVTLGQPASISCRSSQSLEFTDGNTYLSWFQQRPGQSPRRLIYKVSNRDSGVPDRFSGSGSGTDFTLKINRVEAEDVGVYYCMQGIHWPPTFGPGTKVEIK

SEQ ID NO: 425 - protein, 117 aa, Artificial Sequence
  Description of Artificial Sequence: Synthetic heavy chain variable region amino acid sequence
QVQLQQWGAGVLKPSETLSLTCAVNGRSLSGHYWSWIRQTPGKGLEWIGEINNSGGTHYSPSLKSRVIISGDTAKNQLSLKLSSVTAADTAVYYCAKGSAEWYFDLWGRGTLVTVSS

SEQ ID NO: 426 - protein, 108 aa, Artificial Sequence
  Description of Artificial Sequence: Synthetic light chain variable region amino acid sequence
DIRVTQSPSTLSASVGDRVTITCRASQSVSTWLAWYQQKPGKPPSLLIFKASTLESGVPSRFSGSGSGTEFTLTISSLQPDDFATYYCQQYNTYSPWTFGPGTKVEIK

SEQ ID NO: 427 - protein, 124 aa, Artificial Sequence
  Description of Artificial Sequence: Synthetic heavy chain variable region amino acid sequence
QVQLVESGGGLVKPGGSLRLSCAASGFKFSSYYMHWVRQAPGKGLEWVSSVSGGSTYTSYADSVKGRFTISRDNAKHSLFLQLNSLRAEDTAVYHCVRGDYHPSGTSLNWFDPWGQGTLVTVSS

SEQ ID NO: 428 - protein, 111 aa, Artificial Sequence
  Description of Artificial Sequence: Synthetic light chain variable region amino acid sequence
QPGLTQPPSVSGAPGQRVTISCTGSSSNIGAGYDVHWYKQLPGTVPKLLIYANNNRPSGVPDRFSGSESGTSASLAITGLQAEDEADYYCQSYDSSLNAYVFGTGTKVTVL

SEQ ID NO: 429 - protein, 122 aa, Artificial Sequence
  Description of Artificial Sequence: Synthetic heavy chain variable region amino acid sequence
QVQLVQSGAEVKKPGASVKVSCKASGYTFSHYGLSWVRQAPGQGLEWMGWISAYNHNTNYAQKFQGRVTITTDTSTSTAYLEMRSLRSDDTAVYYCAREPPSDTAAGTGDYWGQGTLVTVSS

SEQ ID NO: 430 - protein, 112 aa, Artificial Sequence
  Description of Artificial Sequence: Synthetic light chain variable region amino acid sequence
DIVMTQSPLSLSVTLGQPASISCRSSQSLVYSDGNTYLTWFQQRPGQSPRRLIYKVSNRDSGVPDRFSGSGSGTDFTLKISRVEAEDVGVYYCMQGTQWPRTFGQGTKVDIK

SEQ ID NO: 431 - protein, 125 aa, Artificial Sequence
  Description of Artificial Sequence: Synthetic heavy chain variable region amino acid sequence
EVQLVESGGGLAKPGGSLRLSCAASGFTFSHYNMNWVRQAPGKGLEWVSSISSTGFHIYYADSVKGRFVISRDNAENSLHLQMNSLRADDTGLYYCVRAEYYYGSGSAGHYFDSWGQGTLVTVSS

SEQ ID NO: 432 - protein, 109 aa, Artificial Sequence
  Description of Artificial Sequence: Synthetic light chain variable region amino acid sequence
SYVLTQPPSVSVAPGHTAKITCGGSIIGTKSVHWYQQKPGQAPVLVVYDDSDRPSGIPERLSGSRSGNTATLTITRVEAGDEADYYCQVWDSSSEHAGVFGGGTKLTVL

SEQ ID NO: 433 - protein, 121 aa, Artificial Sequence
  Description of Artificial Sequence: Synthetic heavy chain variable region amino acid sequence
QVQLVQSGAEVKKPGASVKVSCKASGYTFTHYGISWVRQAPGQGLEWMGWISAYNGNTNYAQKLQGRVTMTTDTSTSTAYMEVRSLRYDDTAVYYCARDVPVEAATSPEFWGQGTLVTVSS

SEQ ID NO: 434 - protein, 113 aa, Artificial Sequence
  Description of Artificial Sequence: Synthetic light chain variable region amino acid sequence
DIVMTQTPLSLPVTLGQPASISCRSSQSLVYSDGNTYLSWFQQRPGQSPRRLIYKVSNRDSGVPNRFSGSGSGTDFTLKISRVEAEDVGVYYCVQNTHWPAYTFGQGTKVEIK

SEQ ID NO: 435 - protein, 123 aa, Artificial Sequence
  Description of Artificial Sequence: Synthetic heavy chain variable region amino acid sequence
QVQLVQSGAEVKKPGASVKVSCKASGYNFTNYGISWVRQAPGQGLEWMGWISTSNGNTHYAQKSQGRITLTTDTSTNTAYMEVRSLRSDDTAVYYCAREGPESTYDWYHFDSWGQGTLVTVSS

SEQ ID NO: 436 - protein, 108 aa, Artificial Sequence
  Description of Artificial Sequence: Synthetic light chain variable region amino acid sequence
QSVVTQPPSVSVAPGQTAKITCGGNNIGSKTVHWYQLKAGQAPVLVVYDDSDRPSGIPERFSGSNSGNTATLTIRRVEAGDEADYFCQVWESASDHWVFGGGTKLTVL

SEQ ID NO: 437 - protein, 122 aa, Artificial Sequence
  Description of Artificial Sequence: Synthetic heavy chain variable region amino acid sequence
EVQLLESGGGLGKPGGSLRLSCAASGFKLSSYYMHWVRQAPGKGPEWVSSISASSSYINYADSVRGRFTVSRDNAKNSLFLQMNSLRVDDTAIYYCARGAPLTNFGMVLDSWGQGTLVTVSS

SEQ ID NO: 438 - protein, 110 aa, Artificial Sequence
  Description of Artificial Sequence: Synthetic light chain variable region amino acid sequence
QSVLTQPPSVSGAPGQRVTISCTGSGSNIGAGYDVHWYQQVPGRVPKLLIYANNNRPSGVPDRFSGSKSGTSASLAITGLQADDEADYYCQSYDRSLNVVFGGGTKLTVL

SEQ ID NO: 439 - protein, 119 aa, Artificial Sequence
  Description of Artificial Sequence: Synthetic heavy chain variable region amino acid sequence
EVQLLESGGGVVQPGRSVRLSCAASGFSFSSYALHWVRQAPGKGLEWVGVIWYEESNKYYADPVKGRFTISRDNSKNTLYLQMNSLRDEDTAVYYCARKGVATAGLDYWGQGTLVTVSS

SEQ ID NO: 440 - protein, 112 aa, Artificial Sequence
  Description of Artificial Sequence: Synthetic light chain variable region amino acid sequence
EIVLTQSPLSLPVTPGEPASISCRSSQSLLNSNGYNYLDWYLQKPGQSPQLLIYLGSNRASGVPDRFSGSGSGTDFTLKISRVEAEDVGVYYCMQALQTPQTFGPGTKVDIK

SEQ ID NO: 441 - protein, 125 aa, Artificial Sequence
  Description of Artificial Sequence: Synthetic heavy chain variable region amino acid sequence
QVQLQQWGAGLLKPSETLSLTCAMYGGSFSDDYWSWIRQPPGKGLEWIGEVNHGGSTNYNTSLKSRVTISADTSKKQFSLKLRSVTAADTAVYFCARGWRYCNATTCYSKAFDIWGQGTMVTVSS

SEQ ID NO: 442 - protein, 107 aa, Artificial Sequence
  Description of Artificial Sequence: Synthetic light chain variable region amino acid sequence
DIQMTQSPSSLSASVGDRVTITCQASQDIDIYLIWYQQKPGRAPKLLIYDASNLKTGVPSRFSGSGSGTEFTFTINNLQPEDFATYYCQQFHDLPLTFGGGTKLEIK

SEQ ID NO: 443 - protein, 125 aa, Artificial Sequence
  Description of Artificial Sequence: Synthetic heavy chain variable region amino acid sequence
EVQLVESGGGLVKPGGSLRLSCAASGFKFSSYTMNWVRQAPGKGLEWVSSVSASSSYIFYADSVQGRFIISRDNAQNSLYLQMNSLRADDTAVYYCARDQYGPGHYYNPAWFDPWGQGTLVTVSS

SEQ ID NO: 444 - protein, 110 aa, Artificial Sequence
  Description of Artificial Sequence: Synthetic light chain variable region amino acid sequence
QPVLTQPPSVSGAPGQRVTISCTGTSSNIGAGYDVHWYKQLPGTAPKVLIYGNTNRPSGIPDRFSGSKSGTSASLAITGLKAEDEADYYCQSYDRSGSKVFGTGTKLTVL

SEQ ID NO: 445 - protein, 131 aa, Artificial Sequence
  Description of Artificial Sequence: Synthetic heavy chain variable region amino acid sequence
EVQLLESGGGLVKPGGSLRLSCAVSGFSFSNAWMSWVRQAPGKGLEWVGRIRSKTDGGTTDYAAPVKGRFTISRDDSKNTLYLQMNSLKTEDTAVYYCTTAPRYSTSWYPGYYYYYYMDVWGKGTTVTVSS

SEQ ID NO: 446 - protein, 106 aa, Artificial Sequence
  Description of Artificial Sequence: Synthetic light chain variable region amino acid sequence
DIQMTQSPSSLSASVGDRVTITCQASQDINFYLNWYQQKPGKAPKLLIYDASNLETGVPSRFSGSVSGTDFTFTISSLQPEDFATYYCQQYDDLPAFGGGTKVEIK

SEQ ID NO: 447 - protein, 125 aa, Artificial Sequence
  Description of Artificial Sequence: Synthetic heavy chain variable region amino acid sequence
EVQLVESGGGLVKPGESLRLSCAASGFTFSDYSMTWIRQAPGKGLLEWIAYINSQSNYMDYADSVKGRFTISRDNAKNSLYLQMNGLRADDTAVYFCARDRRTFVAATLGWFDPWGQGTLVTVSS

SEQ ID NO: 448 - protein, 107 aa, Artificial Sequence
  Description of Artificial Sequence: Synthetic light chain variable region amino acid sequence
ETTLTQSPATLSVSPGERATLSCRASQSVSNNVAWYQQKPGQAPRVLIYAASTRATGIPARFSGSESGTEFTLTISSLQSEDFAVYYCQQYNNWPRTFGQGTKLEIK

SEQ ID NO: 449 - protein, 123 aa, Artificial Sequence
  Description of Artificial Sequence: Synthetic heavy chain variable region amino acid sequence
QVQLQQWGAGLLRPSETLSLTCAVSGGSFSGHYWSWIRQPPGKGLEWIGGINHSGNTNYSPSLRSRVTMSVDTSRNQFSLMLRSVTAADTAVYFCARNVPNLYGDYPRWFDPWGQGTLVTVSS

SEQ ID NO: 450 - protein, 111 aa, Artificial Sequence
  Description of Artificial Sequence: Synthetic light chain variable region amino acid sequence
QSVLTQPASVSGSPGQSITISCTGTSSDVGGFNYVSWYQHHPGKAPKLMIYDVNNRPSGASNRFSGSKSGNTASLTISGLQAEDEADYYCSSYRSSDTLYVFGTGTKVTVL

SEQ ID NO: 451 - protein, 123 aa, Artificial Sequence
  Description of Artificial Sequence: Synthetic heavy chain variable region amino acid sequence
EVQLLESGGGLVKPAGSLRLSCAASGFSFSSYYMNWIRQAPGKGLEWVSDISGGSSYTNYADSVKGRFTVSRDNAKNSVYLQMNSLRGEDTAVYYCARGASTAATYTPTFDYWGQGILVTVSS

SEQ ID NO: 452 - protein, 110 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLMFGNNNRPSGVPDRFSGSKSGTSASLAITGLRPEDEADYYCQSYDRRLTVVFGGGTKLTVL

SEQ ID NO: 453 - protein, 122 aa, Artificial Sequence
  Description of Artificial Sequence: Synthetic heavy chain variable region amino acid sequence
EVQLVESGGGLVKPGGSLRLSCAASGFSFSSYQINWVRQAPGKGLEWVSSISGGSSYTDYADSIKGRFTISRDNAKKSAFLQMKSLRADDTAVYYCARALMATAGGLAFDIWGQGTMVTVSS

SEQ ID NO: 454 - protein, 110 aa, Artificial Sequence
  Description of Artificial Sequence: Synthetic light chain variable region amino acid sequence
QPVLTQPPSVSGAPGQRVTISCTGSGSNIGAGYDVHWYQQVPGTAPKLLILRNTNRPSGVPDRFSGSKSGTSASLAITGLQAEDEADYYCQSYDRSLSVVFGGGTKLTVL

SEQ ID NO: 455 - protein, 121 aa, Artificial Sequence
  Description of Artificial Sequence: Synthetic heavy chain variable region amino acid sequence
QVQLVESGTHVKKPGASVKVSCEASDDTFNNKGIVWVRQAPGQGLEWMGWIRPNNGNTKYAQKFQGRVTMTTDASTNTAYMELRSLRSGDTAVYYCAREQFKWNDFYFDYWGQGILVTVSS

SEQ ID NO: 456 - protein, 108 aa, Artificial Sequence
  Description of Artificial Sequence: Synthetic light chain variable region amino acid sequence
SYELMQPPSVSVAPGQTATITCGGSNIGSETVHWYQQKPGQAPVLVVHDDTDRPSGIPERFSGSNSGNTATLTISGVEAGDEADFYCQVRDSRTDDVVFGGGTKLTVL

SEQ ID NO: 457 - protein, 128 aa, Artificial Sequence
  Description of Artificial Sequence: Synthetic heavy chain variable region amino acid sequence
QVQLVESGGDLVQKGGSLRLSCAASGFTFDNYAMTWIRQAPGQGLEWVSTVSGFVLGTGYTTYYADSVKGRFTISRDSSKNTVYLQLNSLRAEDTAVYYCAKCAATRNECLWDYLQQWGQGTTVTVSS

SEQ ID NO: 458 - protein, 107 aa, Artificial Sequence
  Description of Artificial Sequence: Synthetic light chain variable region amino acid sequence
EIVMTQSPSSLSASVGDRVTITCRASQSVSIYLNWYQQKGGKAPKLLIYGASALQRGVPSRFSGSGSGTDFTLTITSLQPEDFATYFCHQSYSAPQTFGQGTKVDIK

SEQ ID NO: 459 - protein, 133 aa, Artificial Sequence
  Description of Artificial Sequence: Synthetic heavy chain variable region amino acid sequence
EVQLVESGGGLVQPGGSLRLSCAASGFTFTNYAMSWVRQAPGKGLEWVSGISGSGGSTYYADSVKGRFTISRDNSKNTLYLQMNSLRAEDTAVYYCAKDQGYAVVVADATRNLPPRRYGMDVWGQGTTVTVSS

SEQ ID NO: 460 - protein, 109 aa, Artificial Sequence
  Description of Artificial Sequence: Synthetic light chain variable region amino acid sequence
EIVLTQSPGTLSLSPGERATLSCRASHSVSSSYLAWYQQKPGQAPRLLIYGASSRATGIPDRFSGSGSGTDFTLTISRLEPEDFAVYYCQQYGSSPPLTFGGGTKVDIK

SEQ ID NO: 461 - protein, 121 aa, Artificial Sequence
  Description of Artificial Sequence: Synthetic heavy chain variable region amino acid sequence
EVQLVESGAEVKKPGASVKVSCKASGYTFGNYGISWVRQAPGQGLEWMGWISAYNGNSNYAQKFQGRVTMTTDTSASTAYMEVRSLRSDDTAVYYCARDVPVTAARLLDYWGQGTLVTVSS

SEQ ID NO: 462 - protein, 113 aa, Artificial Sequence
  Description of Artificial Sequence: Synthetic light chain variable region amino acid sequence
DIVLTQTPLSLPVTLGQPASISCRSSQSLVYSDGNTYLSWFQQRPGQSPRRLIYKVSNRDSGVPDRFSGSGSGTDFTLKISRVEAEDVGVYYCMQATDWLGYTFGQGTKLEIK

SEQ ID NO: 463 - protein, 119 aa, Artificial Sequence
  Description of Artificial Sequence: Synthetic heavy chain variable region amino acid sequence
EVQLQESGPGLVKPSETLSLTCTVSGGSLRSYYWSWIRQPPGKGLEWIGNIYYGGSTNYNSSLKGRVTISIDTSKNQFSLRLSSVTAADTAVYYCARDGLFPMGEWDYWGQGILVTVSS

SEQ ID NO: 464 - protein, 110 aa, Artificial Sequence
  Description of Artificial Sequence: Synthetic light chain variable region amino acid sequence
QSALTQPASVSGSPGQSITISCTGTSNDVGDYNYVSWYQQHPGEAPKLMIYEVTNRPSGVSDRFSGSKSGNTASLTISGLQAEDEADYYCSSYTSSTSVVFGGGTQLTVL

SEQ ID NO: 465 - protein, 118 aa, Artificial Sequence
  Description of Artificial Sequence: Synthetic heavy chain variable region amino acid sequence
QVQLQESGPGLVKPSQTLSLTCSVSGGSVSSGDYYWTWIRQPAGKGLEWIGRIYNSGGTDYSPSLKSRVTISVDTSKNQFSLKLSSVTAADTAVYYCARGRGYYESPWGQGTLVTVSS

SEQ ID NO: 466 - protein, 106 aa, Artificial Sequence
  Description of Artificial Sequence: Synthetic light chain variable region amino acid sequence
EIVLTQSPATLSLSPGERATLSCRASQSVGIYIGWYQQKPGQAPRLLMYDASNRATGIPDRFSGSGSGTDFSLTISSLEPEDFAVYYCQLRSKWLTFGPGTKVEIK

SEQ ID NO: 467 - protein, 120 aa, Artificial Sequence
  Description of Artificial Sequence: Synthetic heavy chain variable region amino acid sequence
QVQLQESGPRLVKPSETLSLTCTVSGDSISSRNYFWAWIRQPPGKGLEWIGTIYYSGNTYSNPSLKSRVTISVDTSKKQFSLNLSSVTAADTAVYYCARGAYGGDAFDIWGQGTVVTVSS

SEQ ID NO: 468 - protein, 107 aa, Artificial Sequence
  Description of Artificial Sequence: Synthetic light chain variable region amino acid sequence
DIRVTQSPSSVSASVGDRVTITCRASQGIGTWLAWYQQKPGKAPHLLIYAASRLQSGVPSRFSGSGSGTDFTLSISSLHPEDFATYYCQQAYAFPRTFGQGTKVEIK

SEQ ID NO: 469 - protein, 125 aa, Artificial Sequence
  Description of Artificial Sequence: Synthetic heavy chain variable region amino acid sequence
EVQLVESGPGLVKPSQTLSLTCSVSGVSISRGSYYWSWIRQPAGGGLEWIGRIYTSGVTRYNPSLESRVTISLDSSQNQFFLRLSSVTAADTAVYYCATRESASYSSGPDAFDIWGQGTTVTVSS

SEQ ID NO: 470 - protein, 107 aa, Artificial Sequence
  Description of Artificial Sequence: Synthetic light chain variable region amino acid sequence
DIQMTQSPSTLSASVGDRVIITCRASQSVNSWLAWYQQKPGKAPKLLIYQASSLESGVPSRFSGSGSGTEFTLTINSLQPDDFATYYCQQYKTFSRPFGQGTKVEIK

SEQ ID NO: 471 - protein, 132 aa, Artificial Sequence
  Description of Artificial Sequence: Synthetic heavy chain variable region amino acid sequence
EVQLVESGGALVQPGGSLRLSCSASGFTFSSYAMHWVRQAPGKGLEYVSAINNFGDKTYYTDSVEGRFTISRDNSKKTLYLQMSSLRPEDTAVYYCVKDRGYCSSPSCYAVPYYYFYGMDVWGQGTTVTVSS

SEQ ID NO: 472 - protein, 107 aa, Artificial Sequence
  Description of Artificial Sequence: Synthetic light chain variable region amino acid sequence
EIVMTQSPSSLSASVGDRVTITCQASQGISNYLHWYQQKPGKAPKLLIYDASNLEAGVPSRFSGSGAGTDFTFTISSLQPEDVATYYCQHYNNLPFTFGPGTKVDIK

SEQ ID NO: 473 - protein, 118 aa, Artificial Sequence
  Description of Artificial Sequence: Synthetic heavy chain variable region amino acid sequence
EVQLLETGAEVKKPGASVKVSCHVSGYGLTDLSMHWVRQAPGKRLQWMGSFDPQYGETIDTQNFQGRVTMTVDTSTATLYMQLSGLRSEDTAMYYCATPQSTGALDNWGQGTLVTVSS

SEQ ID NO: 474 - protein, 115 aa, Artificial Sequence
  Description of Artificial Sequence: Synthetic light chain variable region amino acid sequence
DIRVTQSPSSLSASVGDRVTITCRASQSISSYLSWYQQKPGKAPRLVIFAASNLQSGVPSRFSGTGSSRFSDSGSWTDFTLTISSLQPEDFAIYYCQQTYITPFTFGQGTKVDIK

SEQ ID NO: 475 - protein, 128 aa, Artificial Sequence
  Description of Artificial Sequence: Synthetic heavy chain variable region amino acid sequence
EVQLVESGGGLVQPGGSLRLSCVASGFTFSNYWMNWVRQAPGKGLEWVANIKEDGSEIKYVDSVKGRFTISRDNAKNSLYLQMNSLRAEDTAVYYCARTEDSSSWFVAIDYYNYMDVWGKGTTVTVSS

SEQ ID NO: 476 - protein, 109 aa, Artificial Sequence
  Description of Artificial Sequence: Synthetic light chain variable region amino acid sequence
DIQVTQSPGTLSLSPGERATLSCRASQTVSSSYLAWYQQKPGQAPRLLFYGASSRATDIPDRFSASGSGTDFTLTIHRLEPEDFAVYYCQLYGRSPPYTFGQGTKVEIK

SEQ ID NO: 477 - protein, 121 aa, Artificial Sequence
  Description of Artificial Sequence: Synthetic heavy chain variable region amino acid sequence
QVQLVQSGGGVVHPGRSLRLSCAASGFSFSDYGMHWVRQAPGKGLEWVAVIWYDGINKYYADSVKGRFAISRDNSKNTLYLQMNSLRAGDTAVYYCARGGIAAAQRYFDYWGQGTLVTVSS

SEQ ID NO: 478 - protein, 105 aa, Artificial Sequence
  Description of Artificial Sequence: Synthetic light chain variable region amino acid sequence
ETTLTQSPGTLSLSPGERATLSCRASQTVSSSNLAWYQQKPGQAPRLLIYGASSRATGIPDRFSGSGSGTDFTLTISRLEPEDFAVYYCQQSGTSFGQGTKVDIK

SEQ ID NO: 479 - protein, 121 aa, Artificial Sequence
  Description of Artificial Sequence: Synthetic heavy chain variable region amino acid sequence
EVQLVESGGEVKKPGASVKVSCKTSGYPFSNYGISWMRLAPGQGLEWMGWISSYNGNTYYTKKFQGRVSMTTDTSTSTAYMELRSLRSDDTAVYYCARDVPVIAAHTFEYWGQGTLVTVSS

SEQ ID NO: 480 - protein, 113 aa, Artificial Sequence
  Description of Artificial Sequence: Synthetic light chain variable region amino acid sequence
ETTLTQSPLSLPVTLGQPASISCRSSESLVYSDGNTYLSWFQQRPGQSPRRIIYKVSNRDSGVPDRFSGSGSGTDFTLKISRVEAEDVGVYYCMQATHWPRDTFGQGTKVDIK

SEQ ID NO: 481 - protein, 126 aa, Artificial Sequence
  Description of Artificial Sequence: Synthetic heavy chain variable region amino acid sequence
EVQLLESGPGLVKPSGTLSLTCAVSGGSIINSNWWSWVRQSPGKGLEWIGDIYHSGSTTYNPSLKSRVTISVDRSKNQYSLRLTSVTAADTAVYYCAKIGPDNRSGPDYYYFMDVWGKGTTVTVSS

SEQ ID NO: 482 - protein, 107 aa, Artificial Sequence
  Description of Artificial Sequence: Synthetic light chain variable region amino acid sequence
EIVLTQSPSSLPASVGDRVTISCRASQSISNYVYWYQQKPGKAPKLLIYAASSLQSGVPSRFSGSGSGTDFTLSISSLQFEDFATYFCQQSYSTPPTFGQGTKLEIK

SEQ ID NO: 483 - protein, 118 aa, Artificial Sequence
  Description of Artificial Sequence: Synthetic heavy chain variable region amino acid sequence
EVQLVESGGGVVQPGRSLRLSCSASGFPFHSYAMHWVRQAPGKGLEWVAGIWYEGSSESYADSVKGRLTISRDNSRNTLYLQMNSLRVEDTAVYYCARRGSFSGFDSWGQGSLVTVSS

SEQ ID NO: 484 - protein, 112 aa, Artificial Sequence
  Description of Artificial Sequence: Synthetic light chain variable region amino acid sequence
DIVMTQSPLSLPVTPGEPASISCRSSQSLLHSNGYNYLDWYLQKPGQSPQLLISLGSNRASGVPDRFSGSVAGTDFTLKISRVEAEDVGVYYCMQSSQTPYTFGQGTKVDIK

SEQ ID NO: 485 - protein, 122 aa, Artificial Sequence
  Description of Artificial Sequence: Synthetic heavy chain variable region amino acid sequence
EVQLVESGGNLVKPGGSLRLSCAASGFTFSGYYMSWIRQAPGKGLEWISDISGGSSYTNYADSVKGRFTISRDNAKNSLYLQMNSLRAEDTAMYYCARVEYDTTGPFHFDYWGQGTLVTVSS

SEQ ID NO: 486 - protein, 111 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNNNRPSGVPDRLSGSKSGTSASLAITGLQAEDEADYYCQSYDSSLSGYVFGTGTKVTVL

SEQ ID NO: 487 - protein, 129 aa, Artificial Sequence
  Description of Artificial Sequence: Synthetic heavy chain variable region amino acid sequence
EVQLVESGGGLVQPGGSLRLSCVVSGFTFKSYWMTWVRQAPGKGLEWVANIKEDGSEKYYVDSVKGRFTISRDNARNSLFLQMNSLRADDTAVYYCARNLEVSNEFYVVTDNYYLMDVWGQGTTVTVSS

SEQ ID NO: 488 - protein, 107 aa, Artificial Sequence
  Description of Artificial Sequence: Synthetic light chain variable region amino acid sequence
DIQLTQSPSSLSASVGDRVTITCRASQSISFFLNWYRQKPGKAPKLLIYAASTLQSGVPSRFSGSGSGTDFTLTISSLQPEDFASYYCQQSYSTPHTFGQGTKVEIK

SEQ ID NO: 489 - protein, 118 aa, Artificial Sequence
  Description of Artificial Sequence: Synthetic heavy chain variable region amino acid sequence
EVQLVESGGGVVQPGRSLRLTCAASGFPFSSYAMHWVRQAPGKGLEWVAVTWYDGPNRDYADSVKGRFTVSRDNSKNTLYLQMTSLRADDTAVYYCARRGSWGSFDYWGQGTLVTVSS

SEQ ID NO: 490 - protein, 112 aa, Artificial Sequence
  Description of Artificial Sequence: Synthetic light chain variable region amino acid sequence
DIVMTQSPLSLSATPGEPASISCRPSQSLLHSNGYNYLEWYLQKPGQSPQLLIYLGSNRASGVPDRFSGGGSGTDFTLRISRVEADDVGVYYCMQASQTPYTFGQGTKVEIK

SEQ ID NO: 491 - protein, 121 aa, Artificial Sequence
  Description of Artificial Sequence: Synthetic heavy chain variable region amino acid sequence
QVQLVQSGAEVKKPGASVKVSCKASGYTFSSNVIGWVRQAPGQGLEWMGWISTNNGNTKYGQKFQGRVTMTTDPSTSTAYMELRSLRSDDTAFYYCARESLGMGGFYFDYWGQGTLVTVSS

SEQ ID NO: 492 - protein, 108 aa, Artificial Sequence
  Description of Artificial Sequence: Synthetic light chain variable region amino acid sequence
QPVLTQPPSVSVAPGQTARITCGGDNIGSKSVHWYQQKPGQAPVLVVYDDSDRPSGIPERFSGSNSGNTASLTISRVEAGDEADYCCQVWDSGSDLWVFGGGTKLTVL

SEQ ID NO: 493 - protein, 126 aa, Artificial Sequence
  Description of Artificial Sequence: Synthetic heavy chain variable region amino acid sequence
QVQLVESGPALVKPTQTLTLTCTFSGFSLTTRGMCVSWIRQPPGKALEWLARIDWDDDKYYSTSLKTRLTISKDTSKNQVVLTMTNMDPVDTATYYCARASTLTTAGYYLHYKDVWGNGTTVTVSS

SEQ ID NO: 494 - protein, 106 aa, Artificial Sequence
  Description of Artificial Sequence: Synthetic light chain variable region amino acid sequence
DIRMTQSPSSLSASVGDRVTITCRASQSIGTYLNWFQQKPGKAPNLLIYAASILHSGVPSRFSGSGSGTDFTLTIRTLQPEDFATYYCQQSYPTVTFGQGTKVEIK

SEQ ID NO: 495 - protein, 119 aa, Artificial Sequence
  Description of Artificial Sequence: Synthetic heavy chain variable region amino acid sequence
EVQLVESGGGVVQPGRSLRLSCAASGFPFNSYGMHWVRQAPGKGLEWLAVIYFDESTAYYADSVKGRFTISRDNSKSTLYLQMNSLRAADTAIYYCTTTVMIPYGGVFWGQGTLVTVSS

SEQ ID NO: 496 - protein, 108 aa, Artificial Sequence
  Description of Artificial Sequence: Synthetic light chain variable region amino acid sequence
EIVMTQSPGTLSLSPGDRATLSCRASQSVGSTHFAWYQQKPGQAPRLLIYAASIRATGIPDRFSGGGSGTDFTLTISRLAPEDFAVYYCQQYGSTPITFGQGTRLEIK

SEQ ID NO: 497 - protein, 123 aa, Artificial Sequence
  Description of Artificial Sequence: Synthetic heavy chain variable region amino acid sequence
QVQLVQSGGGVVQPGRSLRLSCAASGFTLSTYGMHWVRQAPGKGLEWVAVIYYDESNKFYADSVQGRFTISRDDSKNTLFLQMNSLRAEDTAVYYCARESRPRGYSYSDFDSWGQGTLVTVSS

SEQ ID NO: 498 - protein, 108 aa, Artificial Sequence
  Description of Artificial Sequence: Synthetic light chain variable region amino acid sequence
QPGLTQPRSVSGSPGQSVTISCTGTSSDVGTFNYVSWYQQHPGKAPKLMIYDVNQRPSGVPDRFSGSKSGNTASLTISGLQAEDEADYYCCAYAGYYSFGGGTKLTVL

SEQ ID NO: 499 - protein, 124 aa, Artificial Sequence
  Description of Artificial Sequence: Synthetic heavy chain variable region amino acid sequence
QVQLQESGPVLVKPSETLSLTCTVSGGSITSSAYYWGWIRQPPGKGLEWIGSVSYSGTTSYTPSLKSRVTISGDASKEQFSLNLRSVTAADTAVYYCARQTKAFGRRDYGMDVWGQGTTVTVSS

SEQ ID NO: 500 - protein, 111 aa, Artificial Sequence
  Description of Artificial Sequence: Synthetic light chain variable region amino acid sequence
QPVLTQPPSVSAAPGQKVTISCSGSNSNIGSNFVSWYQQLPGTAPKLLIYENNKRPSGIPDRFSGSKSGPSATLGITGLQTEDEADYYCGTWDTGLSAHWVFGGGTKLTVL

SEQ ID NO: 501 - protein, 126 aa, Artificial Sequence
  Description of Artificial Sequence: Synthetic heavy chain variable region amino acid sequence
EVQLVESGPVLVKPRGTLTLTCTVSGFSLSDARMGVSWIRQPPGKALEWLAHIFWDDEKSYSTSLKNRLTISKDTSRGQVVLRMTNMDPVDTGTYFCARVNTYHSGGYYLYYFDVWGQGTLVTVSS

SEQ ID NO: 502 - protein, 108 aa, Artificial Sequence
  Description of Artificial Sequence: Synthetic light chain variable region amino acid sequence
EIVLTQSPSSLSASVGDRVTITCRASQIIASYLNWYQQKPGQAPKLLIYAASSLQSGVPSRFSGSGSGTDFTLTISSLQPEDFATYYCQQSYSTRMYTFGQGTKVEIK

SEQ ID NO: 503 - protein, 127 aa, Artificial Sequence
  Description of Artificial Sequence: Synthetic heavy chain variable region amino acid sequence
EVQLVESGPGLVKPSETLSLTCTVSGGSISDIDYYWGWIRQPPGKGLEWIGSIYYSGSTYYNPSLESRVTISVDTSKNQFSLKLRSVSAADTALYHCARHGPPWVVTAIRGHAFDVWGQGTTVTVSS

SEQ ID NO: 504 - protein, 115 aa, Artificial Sequence
  Description of Artificial Sequence: Synthetic light chain variable region amino acid sequence
DIRVTQSPDSLAVSLGERATINCKSSQSILYSSNNKNYLAWYQQKPGQPPKLLIYWASTRESGVPDRFSGSGSGTDFTLTISSLQAEDVAVYYCQEYYSYPPMYTFGQGTKVDIK

SEQ ID NO: 505 - protein, 125 aa, Artificial Sequence
  Description of Artificial Sequence: Synthetic heavy chain variable region amino acid sequence
QVQLVESGPGLVKPSGTLSLTCAVSGDSINSGNWWNWVRQAPGKGLEWIGEIYHRGTSNYNPSLKSRVTISVDQSKNQFSLKVTSLTAADTAIYYCARARGYSSGPSYYYYLDVWGKGTLVTVSS

SEQ ID NO: 506 - protein, 106 aa, Artificial Sequence
  Description of Artificial Sequence: Synthetic light chain variable region amino acid sequence
EIVMTQSPSSLSASVGDRVTISCRASQSISTYLNWYQQKPGKAPKVIIYGASNLQSGVPSRFSGSGSGTDFTLTISSLQPEDFATYYCQKSFNPCVFGQGTKVDIK

SEQ ID NO: 507 - protein, 122 aa, Artificial Sequence
  Description of Artificial Sequence: Synthetic heavy chain variable region amino acid sequence
QVQLQQWGAGLLKPSETLSLSCAVSGGSFSGYYWTWIRQPPGKGLEWIGEINHSGSTNYNPSLKSRVTISVDTSKNQFSLKLSSVTAADTAVYYCARARYFDYLAHWSFDLWGRGTLVTVSS

SEQ ID NO: 508 - protein, 112 aa, Artificial Sequence
  Description of Artificial Sequence: Synthetic light chain variable region amino acid sequence
GIQMTQSPLSLPVTPGEPASISCRSSQSLLHSNGYKYLDWYLQKPGQSPQLLIYLGSDRASGVPDRFSGSGSGTDFTLKISRVEAEDVGVYYCMQALQTPWTFGQGTKLEIK

SEQ ID NO: 509 - protein, 120 aa, Artificial Sequence
  Description of Artificial Sequence: Synthetic heavy chain variable region amino acid sequence
QVQLQESGGGVVQPGRSLTLSCAASGFTFSSYGMHWVRQAPGKGLDWVAEIWYDGSNKYYVDSVKGRFTISRDNSKNTLYLQMKSLRAEDTAIYYCARDGGYESPFFDKWGQGTLVTVSS

SEQ ID NO: 510 - protein, 112 aa, Artificial Sequence
  Description of Artificial Sequence: Synthetic light chain variable region amino acid sequence
EIVMTQSPDSLGVSLGERATINCKSSQSLYTSNHENSLAWYQQKPGQPPRLLIYWASTRELGVPDRFSGSGSGTDFTLTISSLQAEDVAVYYCQQYHTTPLTFGPGTKVEIK

SEQ ID NO: 511 - protein, 122 aa, Artificial Sequence
  Description of Artificial Sequence: Synthetic heavy chain variable region amino acid sequence
EVQLVESGGAVVQPGGSLRLSCVASGLAFDEYTMHWVRQSSAKGLEWISLISWNGGITYYADSVKGRFTISRDNSKNSLYLQMNSLRTEDTATYFCARLGYGSGSDYGDDYWGQGTLVTVSS

SEQ ID NO: 512 - protein, 108 aa, Artificial Sequence
  Description of Artificial Sequence: Synthetic light chain variable region amino acid sequence
ETTLTQSPGTLSLSPGERATLSCRASQSVSNNYLAWYQQKPGQAPRLLIHGASTRVTGIPARFSGSGSGTDFTLTISRLEPEDFAVYYCHQYHSSPRTFGQGTKVDIK

SEQ ID NO: 513 - protein, 120 aa, Artificial Sequence
  Description of Artificial Sequence: Synthetic heavy chain variable region amino acid sequence
QVTLKESGPTLVKPTQTLTLTCTFSGFSLSISGVGVGWIRQPPGKALEWLAVMYWDDDKRYSPSLKTRLTITKDTSKNQVVLTMTNMAPVDTAIYYCAHLWFGEAAFDPWGQGTLVTVSS

SEQ ID NO: 514 - protein, 112 aa, Artificial Sequence
  Description of Artificial Sequence: Synthetic light chain variable region amino acid sequence
EIVLTQSPLSLPVTLRQTASISCRSGQSLLYSDGNTYLNWFQQRPGQSPRRLISIVSKRDSGVPDRFSGSGSGTDFTLKISRVEAEDVGVYYCMQGTHWPYTFGQGTKVEIK

SEQ ID NO: 515 - protein, 117 aa, Artificial Sequence
  Description of Artificial Sequence: Synthetic heavy chain variable region amino acid sequence
QVQLVQSGADVKKPGASVKVSCKSSGYTFSNHSMHWVRQAPGQGLEWMGRIHPSSGTTTYAQKFQGRVTMTRDTSTSTVYMEVSSLRSEDTAVYYCARSPFFDFDFWGQGTMVTVSS

SEQ ID NO: 516 - protein, 110 aa, Artificial Sequence
  Description of Artificial Sequence: Synthetic light chain variable region amino acid sequence
SYVLTQPHSVSESPGKTVTISCTRSSGSIASNYVQWYQQRPGSAPTSVIYEDNQRPSGVPDRFSGSIDSTSNSASLTISGLKTEDEADYYCQSYYSSGWVFGGGTKLTVL

SEQ ID NO: 517 - protein, 128 aa, Artificial Sequence
  Description of Artificial Sequence: Synthetic heavy chain variable region amino acid sequence
QVQLQESGAGLLKPSETLSLTCTVYGGTFSGYHWNWIRQPPGKGLEWIGEINHRENTDYNASLESRVTISVDTSKRQFSLKMNSVTVADTAVYYCARGIQVLTNLGTEVRVHQFLDLWGRGTLVTVSS

SEQ ID NO: 518 - protein, 108 aa, Artificial Sequence
  Description of Artificial Sequence: Synthetic light chain variable region amino acid sequence
DIVLTQTPATLSLSPGERATLSCRASQSVSTYLAWYQQKPGQAPRLLIYDASNRAAGIPARFSGSGSGTDFTLTISSLEPEDFAVYYCQQRTNWLPLTFGGGTKVDIK

SEQ ID NO: 519 - protein, 127 aa, Artificial Sequence
  Description of Artificial Sequence: Synthetic heavy chain variable region amino acid sequence
QVQLVQSGAEMKTPGASVKVSCKASGYSFSNYGFTWVRQAPGQGLEWMGWISGYSAKTNYAQDLQGRVTMTIDTSTSTSYMELRSLRSDDTAVYYCARDPLGYFGSGTYRGGAFDFWGQGTTVTVSS

SEQ ID NO: 520 - protein, 109 aa, Artificial Sequence
  Description of Artificial Sequence: Synthetic light chain variable region amino acid sequence
QSALTQPASVSGSPGQSITLSCTGTNNDVGSYHLVSWYQQYPGKAPKLVIYEVTKRPSGVSNRFSGSKSGNTASLTISGLQPEDEADYYCCSYAGDRRIFGGGTKVTVL

SEQ ID NO: 521 - protein, 118 aa, Artificial Sequence
  Description of Artificial Sequence: Synthetic heavy chain variable region amino acid sequence
EVQLVESGGGVVQPGRSLRLSCAASGFSFSTYGMHWVRQAPGKGLEWVGVIWYDETTKYYADSVKGRFSISRDNSKNMVYVQMNSLRADDTALYYCAREVWGGVFDIWGQGTTVTVSS

SEQ ID NO: 522 - protein, 107 aa, Artificial Sequence
  Description of Artificial Sequence: Synthetic light chain variable region amino acid sequence
DIQMTQSPATLSASVGDRVTITCRASQNIVTWLAWYQQKPGKAPNLLIYKASSLESGVPSRFSGSGSGTEFTLTISSLQPDDFATYYCQHYNSYSGAFGQGTKVDIK

SEQ ID NO: 523 - protein, 124 aa, Artificial Sequence
  Description of Artificial Sequence: Synthetic heavy chain variable region amino acid sequence
QVQLQESGPGLVKPSETLSLSCTASGDSISDYYWSWIRQPPGKGLEWIGFVSDTWGTNYSPSLTSRVAISLDTSRSQVSLRLRSVTAADTAVYYCVRTHLYDRGGYYLYYFDYWGQGTLVTVSS

SEQ ID NO: 524 - protein, 107 aa, Artificial Sequence
  Description of Artificial Sequence: Synthetic light chain variable region amino acid sequence
DIRMTQSPPSLSASVGDRVTITCRASQRIASYLNWYQQKPDTAPKLLIYAASNLQTGVPSRFSGSGSGTDFTLTISSLQPEDFATYYCQQSYSTPYTFGQGTKLEIK

SEQ ID NO: 525 - protein, 126 aa, Artificial Sequence
  Description of Artificial Sequence: Synthetic heavy chain variable region amino acid sequence
QVQLVQSGPAVVKPTQTLTLTCSFSGFSLSTSRMSVSWIRQPPGKALEWLARIDWDGDKYYSTSLKSRLTISKDTSKNQVVLTMTNMDPVDTATYYCARGSYYVSSGYYLNYFDYWGQGTLVTVSS

SEQ ID NO: 526 - protein, 107 aa, Artificial Sequence
  Description of Artificial Sequence: Synthetic light chain variable region amino acid sequence
DIRMTQSPSSLSASVGDRVTITCRTSQTIASYLNWYQQKPGKAPNLLIYAASILQTGVPSRFSGSGSGTDFTLTISSLQPEDFATYYCQQSYGTPQTFGQGTKVEIK

SEQ ID NO: 527 - protein, 125 aa, Artificial Sequence
  Description of Artificial Sequence: Synthetic heavy chain variable region amino acid sequence
QVQLQESGPGVVKPSETLSLTCTVSGGSISNTHSYWGWIRQSPGKGLEWIGSIYYTGSTYYNPSFRSRVTLSVDTSKNQFSLKLSSVTAADTAVYYCAAPDYFVLTDYKSTFDYWGRGALVTVSS

SEQ ID NO: 528 - protein, 108 aa, Artificial Sequence
  Description of Artificial Sequence: Synthetic light chain variable region amino acid sequence
DIVMTQSPGTLSLSPGGRATLSCRASQSVGSSSLAWYQQKPGQAPRLLIYGASSRAAGIPDRFSGSGSGTDFTLTINRLEPEDFAMYYCQQYGSSPLTFGGGTKVEIK

SEQ ID NO: 529 - protein, 119 aa, Artificial Sequence
  Description of Artificial Sequence: Synthetic heavy chain variable region amino acid sequence
QVQLQESGPGLVKPSETLSLICTVSGGSISNYYWSWIRQPPGKGLEWIGYVWFGTTKYNPSLKNRVTISVDTGKNQVSLKVNSVTAADTAIYYCARDSSIWYRGAFEIWGQGTTVTVSS

SEQ ID NO: 530 - protein, 107 aa, Artificial Sequence
  Description of Artificial Sequence: Synthetic light chain variable region amino acid sequence
DIRLTQSPSSLSASVGDRVTITCQASQDISNHLNWYQQRPGKAPELLIYDASTLETGGPSRFSGSGSGTDFTLTISSLQPEDFADYYCQQYDNLPVTFGGGTKVDIK

SEQ ID NO: 531 - protein, 118 aa, Artificial Sequence
  Description of Artificial Sequence: Synthetic heavy chain variable region amino acid sequence
QVQLVQSGAEVKKPGASVRVSCKVPGNTLSDLSMHWVRHTPGEGLEWMGSFDPEYGETIPAQRFQGRVTMTEDTSTDTAYMELTSLRFEDTAVYYCAAPHASGALQHWGQGTLVTVSS

SEQ ID NO: 532 - protein, 107 aa, Artificial Sequence
  Description of Artificial Sequence: Synthetic light chain variable region amino acid sequence
DIVMTQSPSSLSASVGDRVTITCRASQIISAYLNWYQQKAGKAPKLLIYAASSLQSGVPSRFSGSGSGTDFTLTISSLQPEDFATYYCQQTYITPFTFGQGTKLEIK

SEQ ID NO: 533 - protein, 121 aa, Artificial Sequence
  Description of Artificial Sequence: Synthetic heavy chain variable region amino acid sequence
QVQLVESGTEVKKPGASVKVSCKASGYTFTNYGITWVRQAPGQGLEWMGCISGYNGNTNYAQNLQGRVTMTTDTSTNTAYMELRSLISDDTAVYYCARDTGLTAAALLDYWGQGTLVTVSS

SEQ ID NO: 534 - protein, 112 aa, Artificial Sequence
  Description of Artificial Sequence: Synthetic light chain variable region amino acid sequence
DIVLTQSPLSLPVTLGQPASISCRSSQSLVYSDGNTYLSWFQQRPGQSPRRLIYKVSNRDSGVPDRFGGSGSGTYFTLKISRVEAEDVGIYYCMQAIHWPLTFGGGTKVEIK

SEQ ID NO: 535 - protein, 126 aa, Artificial Sequence
  Description of Artificial Sequence: Synthetic heavy chain variable region amino acid sequence
EVQLLESGGGLVKPGGSLRLSCAGSGFTLSSYGMNWVRQAPGQGLEWISSISSSSSYINYADSVKGRFTISRDNAQNSLYLQLNSLRAEDTAVYYCARGGLGYDYGLGSYTYADYWGQGTLVTVSS

SEQ ID NO: 536 - protein, 111 aa, Artificial Sequence
  Description of Artificial Sequence: Synthetic light chain variable region amino acid sequence
QSVVTQPPSVSGAPGQRVTISCTGSSSNTGAGYDIHWYQQLPGTGPKLLIYGNKNRPSGVPDRFSGSKSGTSASLAITGLQAEDEADYYCQSYDSSLSGWVFGGGTKVTVL

SEQ ID NO: 537 - protein, 123 aa, Artificial Sequence
  Description of Artificial Sequence: Synthetic heavy chain variable region amino acid sequence
EVQLLESGGGLVRPGGSLRLSCAVSGFTFSGNALTWIRRAPGKGLEWVSTIGDSGGGSYYADSVKGRFTISRDNSKSTLYLQMNSLTAEDTAVYYCARDPYGDYRDYYGIDVWGQGTTVTVSS

SEQ ID NO: 538 - protein, 112 aa, Artificial Sequence
  Description of Artificial Sequence: Synthetic light chain variable region amino acid sequence
EIVMTQSPLSLPVTPGEPASISCRSSQSLRHSNGYNYVDWYLQKPGQSPQLLIYLGSNRASGVPDRFRGSGSGTDFTLKISRVEAEDVGVYYCMQALQTPLTFGQGTKVEIK

SEQ ID NO: 539 - protein, 128 aa, Artificial Sequence
  Description of Artificial Sequence: Synthetic heavy chain variable region amino acid sequence
QVQLQQWGAGLLKPSETLSLTCAVHGGSFSGFYWSWIRQSPGKGLEWIAEINDSGNTNHNPSLKSRVTISIDTSKNQFSLNVSSVTAADTAVYYCAKNGGGHHYVGTLRFRSRAFDIWGQGTMVTVSS

SEQ ID NO: 540 - protein, 106 aa, Artificial Sequence
  Description of Artificial Sequence: Synthetic light chain variable region amino acid sequence
EIVMTQSPSTLSASVGDRVTITCRASQSIGNRLAWYQQKPGKAPKLLISLASGLETGVPSRFSGSGSGTEFTLTITSLQPDDFATYYCQQYSSYGTFGQGTKLEIK

SEQ ID NO: 541 - protein, 125 aa, Artificial Sequence
  Description of Artificial Sequence: Synthetic heavy chain variable region amino acid sequence
EVQLVETGPGLVKPSETLSLTCSVSGGSISSYYWSWLRQPPGKGLEWIGYIYNSGRTNYNPSLRSRVTISVDTSQNQFSLRLGSVTAADTAVYYCARGGAGDDLLRGSYRYLNFWGQGTLVTVSS

SEQ ID NO: 542 - protein, 110 aa, Artificial Sequence
  Description of Artificial Sequence: Synthetic light chain variable region amino acid sequence
QSVLTQPPSVSVAPGQTARITCGGNNIGSKSVHWYQQKPGQAPVLVVYDDTERPSGIPERISGSNSGNTATLTISRVEAGDEADYYCQVWDSSSDHPDLLFGGGTKLTVL

SEQ ID NO: 543 - protein, 123 aa, Artificial Sequence
  Description of Artificial Sequence: Synthetic heavy chain variable region amino acid sequence
EVQLVESGGGLVKPGGSLRLSCAASGFRFSSYGMHWVRQAPGRGLEWVSSITAGSSYMDYADSVKGRFSISRDNAKTSLYLQMNSLRAEDTAIYYCARENYDTGRGLNWFDPWGQGTLVTVSS

SEQ ID NO: 544 - protein, 110 aa, Artificial Sequence
  Description of Artificial Sequence: Synthetic light chain variable region amino acid sequence
QSVVTQPPSVSGAPGQRVTISCTGSSSNIGAGYDVHWYRQLPGTAPEVLIYGNNNRPSGVPDRFSGSKTGTSASLAITGLLAEDGADYYCQSYDRSQLWVFGGGTQLTVP

SEQ ID NO: 545 - protein, 119 aa, Artificial Sequence
  Description of Artificial Sequence: Synthetic heavy chain variable region amino acid sequence
EVQLVESGGGLVRPGGSLRLSCEASGLKLSGYSMNWVRQAPGKGLEWVSSISASSSYIHYADSLKGRFTISRDNAKNSLYLQMNSLRAEDTAVYYCVASWLTPGWFDPWGQGTLVTVSS

SEQ ID NO: 546 - protein, 111 aa, Artificial Sequence
  Description of Artificial Sequence: Synthetic light chain variable region amino acid sequence
QPVLTQPPSVSGAPGQTVTISCTGSSSNIGAGYDVHWYQQLPGTAPKLLIYGNTNRPSGVPDRFSGSKSGTSASLAVTGLQAEDEGDYYCQSYDSSLSGSAFGGGTKLTVL

SEQ ID NO: 547 - protein, 122 aa, Artificial Sequence
  Description of Artificial Sequence: Synthetic heavy chain variable region amino acid sequence
QVQLVQSGPGLVKPSQTLSLTCTVSGVSISSGGFYWSWIRQHPGKGLEWIGHIYYSRSTYYNPSLKSRVTMSLNMSKNQFSLRLSSVTAADTAVYYCARERREWLHGELDYWGQGTTVTVSS

SEQ ID NO: 548 - protein, 113 aa, Artificial Sequence
  Description of Artificial Sequence: Synthetic light chain variable region amino acid sequence
DIQMTQSPDSLAVSLGEGATINCKSSQSVLDSSKNKNYLAWYQQRPGQPPKLLISWASTRESGVPDRFSGSGSGTDFTLTISSLQAEDVAVYSCQQYFSPPATFGQGTKLEIK

SEQ ID NO: 549 - protein, 120 aa, Artificial Sequence
  Description of Artificial Sequence: Synthetic heavy chain variable region amino acid sequence
QVQLQESGPGLVKPSGTLSLTCVVSGGSIRSHNYWTWVRQPPGKGLEWIGEIYHSGNTNYNPSLKSRVTLSIDKSKNVFSLRLNSVTAADTAVYYCVGGGPFAPYYFENWGQGTLVTVSS

SEQ ID NO: 550 - protein, 111 aa, Artificial Sequence
  Description of Artificial Sequence: Synthetic light chain variable region amino acid sequence
QSVLTQPPSVSGAPGQRVTISCTGSSSNIGAGYAVHWYHQLPGTAPKLLIYDNNNRPSGVPDRFSGSKSGSSASLAITGLQAEDEADYYCQSYDRSLSGYVFGTGTKLTVL

SEQ ID NO: 551 - protein, 125 aa, Artificial Sequence
  Description of Artificial Sequence: Synthetic heavy chain variable region amino acid sequence
EVQLVESGGALVKPGGSLRLSCVASGFTFSDYYMHWVRQAPGKGLEWVSYISSTSSFTNYADSVKGRFIISRDNAKNSLYLQLNSLRAEDTAVYYCARDESSGWQTRRHFGMDVWGQGTLVTVSS

SEQ ID NO: 552 - protein, 104 aa, Artificial Sequence
  Description of Artificial Sequence: Synthetic light chain variable region amino acid sequence
EIVMTQSPSTLSASVGDRVTITCRASQSLNTWLAWYQHKPGKAPKLLISTASSLQSGVPSRFSASGSGTEFTLTISSLQPDDFATYYCQQFRGTFGPGTKVEIK

SEQ ID NO: 553 - protein, 123 aa, Artificial Sequence
  Description of Artificial Sequence: Synthetic heavy chain variable region amino acid sequence
QVQLVQSGAEVRKPGESLKISCKASGYSFTNYWIGWVRQMPGKGLEWMGIVYPADSHPVYSPSFQGQVTFSTDKSINTAYLQWSSLKASDTAMYFCARRDGGTDYLSDAFDIWGQGTMVTVSS

SEQ ID NO: 554 - protein, 107 aa, Artificial Sequence
  Description of Artificial Sequence: Synthetic light chain variable region amino acid sequence
DIVMTQSPSSLSASVGDRVTITCRTSQSIRRYLNWYQQKPGKAPKLLIYAASSLQSGVPSRFSGSGSGTDFTLTISSLQPEDFATYYCQQSYSTPNTFGQGTKVEIK

SEQ ID NO: 555 - protein, 123 aa, Artificial Sequence
  Description of Artificial Sequence: Synthetic heavy chain variable region amino acid sequence
EVQLVESGGGLVKPGGSLRLSCAASGFKFSTYYMSWIRQAPGKGLEWVSNISGGSSYSNHADSVKGRFTISRDNAKNSLYLEMNSLRAEDTAVYYCAREDLMGVSGLAYFEYWGQGILVTVSS

SEQ ID NO: 556 - protein, 110 aa, Artificial Sequence
  Description of Artificial Sequence: Synthetic light chain variable region amino acid sequence
QPVLTQPPSVSGAPGQRVTISCTGRSSNIGAGYDVNWYKQLPGAVPKVLIYGNTNRPSGVPDRFSGSKSGNSASLAITGLQAEDEADYYCQSYDRNLGYVFGTGTKLTVL

SEQ ID NO: 557 - protein, 123 aa, Artificial Sequence
  Description of Artificial Sequence: Synthetic heavy chain variable region amino acid sequence
EVQLVESGPGLVKPSQTLSLTCTVSGGSISNSNYFWSWIRQPAGKGLEWIGRVHSSGTTSYNPSLKSRITISVDASESQFSLNLTSVTAADTAIYYCARDSSDWGLGWYFDLWGRGTLVTVSS

SEQ ID NO: 558 - protein, 107 aa, Artificial Sequence
  Description of Artificial Sequence: Synthetic light chain variable region amino acid sequence
ETTLTQSPATLSLSPGERATLSCRASQSVTFYLAWYQHKPGQAPRLLIFDASKRATGIPARFSGSGSGTDFTLTISSLEPEDFALYYCQQRSDWPQTFGQGTKVDIK

SEQ ID NO: 559 - protein, 125 aa, Artificial Sequence
  Description of Artificial Sequence: Synthetic heavy chain variable region amino acid sequence
EVQLVESGGGLVKPGGSLRLSCAVSGFKFSSYTMNWVRQAPGKGLEWVSSVSASSSYIFYADSVQGRFIISRDNAQNSLYLQMNSLRADDTAVYYCTRDQYGPGHYYNPAWFDPWGQGTLVTVSS

SEQ ID NO: 560 - protein, 110 aa, Artificial Sequence
  Description of Artificial Sequence: Synthetic light chain variable region amino acid sequence
QPVLTQPPSASGAPGQRVTISCTGSSSNIGAGYDVHWYQQLPGTAPKVLIYGNTNRPSGIPDRFSGSKSGTSASLAIIGLQAEDEADYYCQSYDRNGSKVFGTGTKLTVL

SEQ ID NO: 561 - protein, 119 aa, Artificial Sequence
  Description of Artificial Sequence: Synthetic heavy chain variable region amino acid sequence
QVQLVQSGAEVRKPGDSLKISCKFSENIFTTYYWTGWVRQMPGRGLEWMGIIFPGDSDTRYSPSFQGHVTISVDKSIATAFLQWSSLKASDSAMYYCARAKYEGSFDMWGQGTMVTVSS

SEQ ID NO: 562 - protein, 108 aa, Artificial Sequence
  Description of Artificial Sequence: Synthetic light chain variable region amino acid sequence
DIQVTQSPSSLSASVGDRVSITCQASQDIRNRLNWYQQKPGKAPKLLIYDASILETGVPSRFSGSGSGTDFTFSISSLQPEDFATYYCQQYDSFSLFTFGPGTKVEIK

SEQ ID NO: 563 - protein, 116 aa, Artificial Sequence
  Description of Artificial Sequence: Synthetic heavy chain variable region amino acid sequence
QVQLQQSGAEVKKPGESLTISCKGSGYSFGNYWISWVRQMPGKGLEWMGRIDPSDSYVNYSPSFQGNVTMSVDKSSSTAYLQWSSLKASDTAMYYCARLAGYSTLWGQGTLVTVSS

SEQ ID NO: 564 - protein, 109 aa, Artificial Sequence
  Description of Artificial Sequence: Synthetic light chain variable region amino acid sequence
EIVLTQSPGTLSLSPGERATLSCRASQSFGSIYLAWYQQKPGQAPRLLIYGTSSRATGIPDRFSGSGSGTDFTLTIRRLEPEDFAVYYCLYYGSSPGATFGPGTKVDIK

SEQ ID NO: 565 - protein, 121 aa, Artificial Sequence
  Description of Artificial Sequence: Synthetic heavy chain variable region amino acid sequence
EVQLVESGHEVKKPGASVKVSCKASGYTFPSYGISWVRQAPGQGLEWMGWIVPYNGNTKYAQRFQGRITMTTDSPTSTASMELRGLRSDDTAVYYCARVFGDGYSYGYEYWGQGTLVTVSS

SEQ ID NO: 566 - protein, 107 aa, Artificial Sequence
  Description of Artificial Sequence: Synthetic light chain variable region amino acid sequence
DIVLTQSPSTLSASVGDRVTITCRASQSISIWLAWYQQKPGKAPKLLIYKTSELVSGVPSRFSGSGSGTEFTLTISGLQPDDFATYYCQQGNSYSHTFGQGTKVEIK

SEQ ID NO: 567 - protein, 122 aa, Artificial Sequence
  Description of Artificial Sequence: Synthetic heavy chain variable region amino acid sequence
QVQLVQSGAEVKEPGKSLKISCKGSGNHFGNYWIAWVRQMPGKGLEWMGIIYPGDSDTRYSPSFQDQVTISVDKSINTVYLQWSSLKAADTATYYCAGSKLGNSWYTIYDSWGQGTLVTVSS

SEQ ID NO: 568 - protein, 111 aa, Artificial Sequence
  Description of Artificial Sequence: Synthetic light chain variable region amino acid sequence
NFMLTQPASVSGSPGQSITISCAGPSALIGVYNLVSWYQQVPGKAPKLIIYEGSKRPSGVSHRFSGSKSGYTASLTISGLQTEDEADYYCCSYAGSGTSVVFGGGTKVTVL

SEQ ID NO: 569 - protein, 117 aa, Artificial Sequence
  Description of Artificial Sequence: Synthetic heavy chain variable region amino acid sequence
QVQLVQSGGGVVQPGRSLRLSCAASGFPFSSYAMHWVRQAPGKGLEWVAVIWYPGGEKYSADSVTGRFTISRDNSKNTLYLQMSSLRVEDTAVYYCARRSVGAFDYWGQGTLVTVSS

SEQ ID NO: 570 - protein, 112 aa, Artificial Sequence
  Description of Artificial Sequence: Synthetic light chain variable region amino acid sequence
DIQMTQSPLSLPVTPGEPASISCRSSQSLLNSNGYNYLDWYLQKPGQSPQVLIYLGSHRASGVPDRFSGSGSGTDFTLRISRVEAEDVGVYYCMQAVQTPYTFGQGTKVEIK

SEQ ID NO: 571 - protein, 131 aa, Artificial Sequence
  Description of Artificial Sequence: Synthetic heavy chain variable region amino acid sequence
QVQLVQSGAEVKKPGESLKISCQGFGFSFTSYWIGWVRQTPGKGLEWMGTIYPGDSETRKSPSIQGQVTFSADRSISTAYLQWSGLTASDTAVYYCARLKGGWGTTMAGIRDYFYYGLDVWGQGTTVTVSS

SEQ ID NO: 572 - protein, 110 aa, Artificial Sequence
  Description of Artificial Sequence: Synthetic light chain variable region amino acid sequence
EIVLTQSPGTLSLSPGERATLSCRASQSVSSSYLAWYQQKPGQAPRLLIYGASSRATGIPDRFTGSGSGTDFTLTISRLEPEDFAVYYCQQYATSLGGFTFGPGTKVDIK

SEQ ID NO: 573 - protein, 136 aa, Artificial Sequence
  Description of Artificial Sequence: Synthetic heavy chain variable region amino acid sequence
EVQLVQSGAEVKKPGASVKVSCKASGYTFISYYIHWVRQAPGQGLEWMGVINPSGGITDYAPKFQGRVSMTRDTSTRTVYLELSSLRSDDTAVYYCARDLCITTSCPRYYDYAWRSYRSEGYFDSWGQGTLVTVSS

SEQ ID NO: 574 - protein, 112 aa, Artificial Sequence
  Description of Artificial Sequence: Synthetic light chain variable region amino acid sequence
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQAQQAPFTFGGGTKVEIK

SEQ ID NO: 575 - protein, 124 aa, Artificial Sequence
  Description of Artificial Sequence: Synthetic heavy chain variable region amino acid sequence
EVQLLESGPGLVKPSGTPSLTCAVSGVSITNSNNWWTWVRQPPGKGLEWIGEIYSSGSTNYSPSLKSRVTISLDKSKNQFSLKLSSVTAADTAVYYCARVLGYYGSGGGHLHSWGPGTLVTVSS

SEQ ID NO: 576 - protein, 112 aa, Artificial Sequence
  Description of Artificial Sequence: Synthetic light chain variable region amino acid sequence
SYELTQPPSASGTPGQRVTISCSGSSSNIGAGYDVHWYQQLPGTAPKLLISVNSNRPSGVPDRFSGSKSGTSASLAITGLQAEDEANYYCQSYDNSLSGYVVFGGGTKLTVL

SEQ ID NO: 577 - protein, 123 aa, Artificial Sequence
  Description of Artificial Sequence: Synthetic heavy chain variable region amino acid sequence
EVQLVESGGVVVQPGGSLRLSCAASGFTFDDYTMHWVRQAPGKGLEWVSLISWVGDTTYYADSVKGRFTISRDNSKNSLYLQMNSLRTEDTALYYCAKGGYYDGSGYYYFDYWGQGTLVTVSS

SEQ ID NO: 578 - protein, 107 aa, Artificial Sequence
  Description of Artificial Sequence: Synthetic light chain variable region amino acid sequence
DIRLTQSPSSLSASVGDRVTITCRASQSISNYLNWYQQKPGKAPKLLMYAASSLQSGVPSRFSGSGSGTDFTLTISSLQPEDFATYSCQQSYSTPYTFGQGTKVEIK

SEQ ID NO: 579 - protein, 127 aa, Artificial Sequence
  Description of Artificial Sequence: Synthetic heavy chain variable region amino acid sequence
EVQLVESGPRLVKPSQTLSLTCNVSGVPVNTGGYYWSWIRRHPIKGLEWIGYIYYSGSTHYNPSLRGRATMSVDTSKNQFSLRLSSVTAADTAVYYCAKDTITVLRGVAKKGVFDPWGQGILVTVSS

SEQ ID NO: 580 - protein, 106 aa, Artificial Sequence
  Description of Artificial Sequence: Synthetic light chain variable region amino acid sequence
DIQMTQSPSTLSASVGDRVIITCRASQSISSWLAWYQYKPGKAPNLLIYKATTLDSGVPSRFSGSGSGTEFTLTISSLQPDDFATYYCQQYDSYPTFGQGTKVEIK

SEQ ID NO: 581 - protein, 123 aa, Artificial Sequence
  Description of Artificial Sequence: Synthetic heavy chain variable region amino acid sequence
QVQLVQSGAEVKKPGASVKVSCKASGYTFTSYGITWVRQAPGQGLEWMGWISTYNGKTNYAQKFKGRVTMTTDTSTSTAYVELTSLRSDDTAVYYCAREFPTRIVDSFYMDVWGKGTTVTVSS

SEQ ID NO: 582 - protein, 109 aa, Artificial Sequence
  Description of Artificial Sequence: Synthetic light chain variable region amino acid sequence
SYELTQPPSVSVAPGQTARITCGGSNIGSETVHWYQQKPGQAPVLVVYGDSDRPSGIPERFSGSNSGNTATLTISRVEAGDEADYYCQVWDSRSDDFHVFGSGTKLTVL

SEQ ID NO: 583 - protein, 130 aa, Artificial Sequence
  Description of Artificial Sequence: Synthetic heavy chain variable region amino acid sequence
QVQLVQSGAELKKPGESLKISCKTSGYTFANYWIGWVRQMPGKGLEWMGIIYPGDSDTRYSPSFQGQVTFSADKSINSAYLQWHSLKASDSAIYYCARRFSPDYSDGAAPPTLSDAFDVWGQGTTVTVSS

SEQ ID NO: 584 - protein, 107 aa, Artificial Sequence
  Description of Artificial Sequence: Synthetic light chain variable region amino acid sequence
DIVMTQSPSSLSASVGDRVTITCRASQNINIYLNWYQQKPGKAPKLLIYAASTLQSGVPSRFSGSGSATDFTLTISSLQPEDFATYYCQQSYRTPNDFGRGTKVDIK

SEQ ID NO: 585 - protein, 123 aa, Artificial Sequence
  Description of Artificial Sequence: Synthetic heavy chain variable region amino acid sequence
EVQLVESGGGLVKPGGSLRLSCLASGFKFRSYSMNWVRQAPGTGLVWVASISASSSFIFYADSLKGRFTISRDNDKNSLYLQMNSLTVEDTAVYYCVRDMSGISSGGKTFDYWGQGTLVTVSS

SEQ ID NO: 586 - protein, 108 aa, Artificial Sequence
  Description of Artificial Sequence: Synthetic light chain variable region amino acid sequence
QSVLTQPPSVSGAPGQRVTISCTGSSSNLGAGYDVQWYQQLPGTAPKLLIYGNNNRPSGVPDRFSGSKSGTSASLAITGLRAEDEADYYCQSYDTSPVFGGGTKLTVL

SEQ ID NO: 587 - protein, 126 aa, Artificial Sequence
  Description of Artificial Sequence: Synthetic heavy chain variable region amino acid sequence
EVQLVESGAEAKKPGESLRISCTVSGYSFSKYWVGWVRQTPGKGLEWMGIIDPTDSDTRYSPSFQGQVTISVDNSINTAYLQWSSLKASDTAIYYCARRGQAKCVGNCPRDFMDVWGKGTTVTVSS

SEQ ID NO: 588 - protein, 112 aa, Artificial Sequence
  Description of Artificial Sequence: Synthetic light chain variable region amino acid sequence
SYVLTQPPSVSGAPGQRVTISCAGSSSNIGAGYEVHWYQQLPGTAPKLLIYANRNRPSGVPDRFSGSRSGTSASLAISGLQAEDEADYYCQSYDNNLSGSWVFGGGTKLTVL

SEQ ID NO: 589 - protein, 114 aa, Artificial Sequence
  Description of Artificial Sequence: Synthetic heavy chain variable region amino acid sequence
QVQLQQWGAGLLKPSETLSLTCAVYGGSFSGKYWSWIRQPPGKGLEWIGEFNHDGTTYYNPSLKSRVTISADTPKNQFSLTLHSVTAADTAVYYCARLTILSDWGQGTLVTVSS

SEQ ID NO: 590 - protein, 107 aa, Artificial Sequence
  Description of Artificial Sequence: Synthetic light chain variable region amino acid sequence
DIRMTQSPSSLSASVGDRVTITCQASQDISNYLHWYQQKPGKAPKLLIYDASNLETGVPSRFSGSGSGTDFTFTIHSLQPEDLATYYCQQYYDLPRTFGQGTKLEIK

SEQ ID NO: 591 - protein, 121 aa, Artificial Sequence
  Description of Artificial Sequence: Synthetic heavy chain variable region amino acid sequence
EVQLVESGAEVKKPGASVKVSCKASGYTFSSHAISWVRQAPGHGLEWMGWISVFNGNTNYAQKFQGRVTMTTDTSTSTAYMELRSLRSDDAAVYYCAREVIGVGEFYFDYWGQGTLVTVSS

SEQ ID NO: 592 - protein, 108 aa, Artificial Sequence
  Description of Artificial Sequence: Synthetic light chain variable region amino acid sequence
QSVLTQPPSVSVAPGQTARITCGGNNIGSKSVHWYQQKAGQAPVLVVYDDSDRPSGIPERFLGSNSGNTATLTISRVEAGDEADYYCQVWDSSGDFHVFGTGTKVTVL

SEQ ID NO: 593 - protein, 121 aa, Artificial Sequence
  Description of Artificial Sequence: Synthetic heavy chain variable region amino acid sequence
EVQLVESGGGLVKPGGSLRLSCSASGFAFSSYSMNWVRQAPGKGLEWVSSISASSSYIFYADSVKGRFTISRDNAKNSLYLQMNSLRAEDTAFYYCARALSPGYGDYRDYWGQGTLVTVSS

SEQ ID NO: 594 - protein, 110 aa, Artificial Sequence
  Description of Artificial Sequence: Synthetic light chain variable region amino acid sequence
QSVVTQPPSVSGAPGQRVTISCTGSSSNIGAGYDVHWYQQLPGAAPKLLIYGNNNRPSGVPDRFSGSKSGTSASLAITGLQAEDEADFYCQSYDHNLSVVFGGGTKLTVL

SEQ ID NO: 595 - protein, 121 aa, Artificial Sequence
  Description of Artificial Sequence: Synthetic heavy chain variable region amino acid sequence
QVQLVQSGAEVKKPGASVKVSCTASGYTFANNGISWVRQAPGQGLEWMGWISAYNGNTKYAQTVQGRVTLTTDTSTSTAYMELRSLTSDDTAVYYCAREMGVDAAATFDYWGQGTLVTVSS

SEQ ID NO: 596 - protein, 112 aa, Artificial Sequence
  Description of Artificial Sequence: Synthetic light chain variable region amino acid sequence
EIVMTQSPLFLSVTLGQPASISCRSSQSLVYSDTNTYLTWFQQRPGQSPRRLIYKVSNRDSGVPDRFSGSGSGTYFTLKISRVEAEDIGVYYCMQAIHWPRTFGQGTKLEIK

SEQ ID NO: 597 - protein, 118 aa, Artificial Sequence
  Description of Artificial Sequence: Synthetic heavy chain variable region amino acid sequence
QVQLVESGPGLVRPSQTLSLTCNVSGDFISRGTYYWSWIRQSAGKGLEWIGRIYTSGITDYSPSLKSRVTISVDTSKNQFFLKLASVTAADTAVYYCARGRGYYDSPWGQGTLVTVSS

SEQ ID NO: 598 - protein, 106 aa, Artificial Sequence
  Description of Artificial Sequence: Synthetic light chain variable region amino acid sequence
ETTLTQSPATLSLSPGERATLSCRASESVSTFLGWYQQKPGQAPRLLIYDASNRASGVPARFSGSGSGTDFTLTISSLEPEDFAVYYCQLRNKWLTFGPGTKVDIK

SEQ ID NO: 599 - protein, 122 aa, Artificial Sequence
  Description of Artificial Sequence: Synthetic heavy chain variable region amino acid sequence
QVQLVQSGAEVKKPGASVKVSCKASGYTFTSYGISWVRQAPGQGLEWMGWISAYNGNTNYAQNLQGRVTMTTDTSTSTAYMELRSLRSDDTAMYYCARDAFSRVGYWYFDLWGRGTLVTVSS

SEQ ID NO: 600 - protein, 108 aa, Artificial Sequence
  Description of Artificial Sequence: Synthetic light chain variable region amino acid sequence
SYELTQPPSVSVAPGQAARITCGGNNIGSKTVHWYQQKPSQAPVLVVYDDSDRPSGIPERFSGSNSGNTATLTISRVEAGDEADYYCQVWDSSGDHPVFGGGTKLTVL

SEQ ID NO: 601 - protein, 137 aa, Artificial Sequence
  Description of Artificial Sequence: Synthetic heavy chain variable region amino acid sequence
QVQLQESGPGLVKPSQTLSLTCTVSGVSISNSSGGYYWSWIRQHPGKGLEWIGYIYYSGSTYYNPSSGSTYYNPSLKSRVTVSVDTSKNQFSLKLTSVTAADTAVYYCARDIRGPHKHSLYNWFHPWGQGTLVTVSS

SEQ ID NO: 602 - protein, 107 aa, Artificial Sequence
  Description of Artificial Sequence: Synthetic light chain variable region amino acid sequence
DIQMTQSPSSLSASVGDRVTITCRASQSISSYLNWYQQKPGKAPKLLIYAASSLQTGVPSRFSGSGSGTDFTLTISSLQPEDFATYYCQQSYSTLRTFGQGTKVDIK

SEQ ID NO: 603 - protein, 132 aa, Artificial Sequence
  Description of Artificial Sequence: Synthetic heavy chain variable region amino acid sequence
QVQLVESGGGVVQPGRSLRLSCAASGFSFSNYGMHWVRQAPGKGLEWVVGISFDGSYIFHGGSVTGRFNISRDNSKNTLYLQVNSVRAEDTAVYYCARDPQYYDDWSGYSGLLHYYLYMDVWGKGTTVTVSS

SEQ ID NO: 604 - protein, 107 aa, Artificial Sequence
  Description of Artificial Sequence: Synthetic light chain variable region amino acid sequence
DIQLTQSPSTLSASVGDRVTITCRASQSIGTSLAWYQQIPGKAPKLLIYRASSLESGVPSRFSGGGSGTQFTLTISSLQPDDFATYYCQQYNNYSPTFGQGTKLEIK

SEQ ID NO: 605 - protein, 125 aa, Artificial Sequence
  Description of Artificial Sequence: Synthetic heavy chain variable region amino acid sequence
EVQLVESGGGVVQPGRSLRLSCVGSGFTFSRYGMQWVRQAPGKGLEWAAVIWNDGSNEHYADSVKGRFTISRDNSKNTMYLQMNSLRAEDTALYYCAREGEYSSSWSHWSYLDLWGRGTLVTVSS

SEQ ID NO: 606 - protein, 110 aa, Artificial Sequence
  Description of Artificial Sequence: Synthetic light chain variable region amino acid sequence
QPGLTQPPSASGTPGQRVTISCSGSTSNIGGNTVNWYQQLPGTAPTVLIYQNRQRPSGVPDRFSGSKSGTSASLAISGLQSDDEADYYCAAWDDSLNGWVFGGGTKLTVL

SEQ ID NO: 607 - protein, 123 aa, Artificial Sequence
  Description of Artificial Sequence: Synthetic heavy chain variable region amino acid sequence
EVQLLESGGGLVKPGGSLKLSCAASGFTLRSYYMHWVRQAPGRGLEWVSSISASSSYINYVDAVKGRFTVSRDNAKNSLFLQMNSLRAEDTAVYYCAREGGAMTNFGVVIDIWGQGTMVTVSS

SEQ ID NO: 608 - protein, 112 aa, Artificial Sequence
  Description of Artificial Sequence: Synthetic light chain variable region amino acid sequence
SYVLTQPPSVSGAPGQRVTISCTGSSSNIGAGYDVHWYQQLPGTAPKLLIYTNTNRPSGVPDRFSGSKSGTSASLAITGLQSDDEADYYCQSYDSSLSGPVVFGGGTKLTVL

SEQ ID NO: 609 - protein, 128 aa, Artificial Sequence
  Description of Artificial Sequence: Synthetic heavy chain variable region amino acid sequence
QVQLVQSGAEVKKPGESLKISCKASGYSLSNNWIAWVRQMPGKGLEWMGIVYLGDSDARYSPSFQGQVTFSADKSISTAYLQWSSLQASDTAMYFCARHHGDLVVTSDSRYFYGLDVWGQGTTVTVSS

SEQ ID NO: 610 - protein, 109 aa, Artificial Sequence
  Description of Artificial Sequence: Synthetic light chain variable region amino acid sequence
DIVMTQSPATLSVSPGERATLSCRASQSISSNLAWYQQKPGQAPRLLIYGASTRATGIPARFSGSGSGTEFTLTISSLQSEDFAVYYCQQYNNWPPSDTFGQGTRLEIK

SEQ ID NO: 611 - protein, 131 aa, Artificial Sequence
  Description of Artificial Sequence: Synthetic heavy chain variable region amino acid sequence
QVQLQESGPGLVKPSETLSLTCTVSGGSISGTTYYWAWIRQPPGKGLEWIGTIFYSGSTYYNPSLQSRVTTSVDASKNQMSLRLSSVTAADTAMYYCARHTSIYDNLTGFYSHLTGVLDMWGQGTMVTVSS

SEQ ID NO: 612 - protein, 109 aa, Artificial Sequence
  Description of Artificial Sequence: Synthetic light chain variable region amino acid sequence
DIQLTQSPATLSVSPGERATLSCRASQSVSTNLAWYQQKRGQAPRLLIYGASTRAIGIPARFSGSGSGTEFTLTISSLQSEDFAVYYCQQYNNWPPAYTFGQGTKVDIK

SEQ ID NO: 613 - protein, 123 aa, Artificial Sequence
  Description of Artificial Sequence: Synthetic heavy chain variable region amino acid sequence
QVQLVQSGAEVKRPGDSLKISCKGSGYSFTTSWIGWVRQVPGKGLEWMGIIYPGDSNTVYGPSLQGQVTISADKSTNTAYLQWSSLKASDTAMYYCARRDGGTDYLSDAFDIWGQGTFVTVSS

SEQ ID NO: 614 - protein, 107 aa, Artificial Sequence
  Description of Artificial Sequence: Synthetic light chain variable region amino acid sequence
DIQMTQSPSSLSASVGDRVTITCRTSQNIVIYLNWYQQKPGKAPKLLIFAASSLPSGVPSRFSGSGSGTDFTLTISSLQPEDVATYYCQQSYNTPGTFGQGTKVDIK

SEQ ID NO: 615 - protein, 117 aa, Artificial Sequence
  Description of Artificial Sequence: Synthetic heavy chain variable region amino acid sequence
EVQLVESGGGLVKPGGSLRLSCEASGFRLSDYYMTWIRQAPGKGLECISYISGGSTFKSYSDSVKGRFTISRDNTNLYLQMNSLRVEDTAVYYCARAPYLIYYMDVWGKGTTVTVSS

SEQ ID NO: 616 - protein, 113 aa, Artificial Sequence
  Description of Artificial Sequence: Synthetic light chain variable region amino acid sequence
QPVLTQPPSVSGAPGQRVSISCTGSNSNIGAGYDVHWYQQLPGTPPKLLIYDNNNRPSGVPDRFSGSKSGTSASLAITGLQAEDEADYYCQSYDNRLSGSQVLFGGGTKVTVL

SEQ ID NO: 617 - protein, 120 aa, Artificial Sequence
  Description of Artificial Sequence: Synthetic heavy chain variable region amino acid sequence
QVQLVQSGAEVKKPGSSVKVSCKASGGTFSNYPISWVRQAPGHGLEWMGRVVPTVGLANYAQNLQGRVTITADTSTNTVYMELRSLRSEDTGLYYCARRAVVDTYAFDIWGQGTLVTVSS

SEQ ID NO: 618 - protein, 112 aa, Artificial Sequence
  Description of Artificial Sequence: Synthetic light chain variable region amino acid sequence
QSALIQPASVSGFPGQSITISCTGASSDVGGYNFVSWYQQHPGKAPKLIIYEVTKRPSGVSNRFSGSESGNTASLTISGLQAEDEADYYCSSFRYTSSIVYVFGSGTKVTVL

SEQ ID NO: 619 - protein, 125 aa, Artificial Sequence
  Description of Artificial Sequence: Synthetic heavy chain variable region amino acid sequence
EVQLLESGGGLVKPGGSLRLSCAASGFTFSDYDMIWVRQAPGKGLEWVSSISRGSDYIYYADSLKGRFTISRDNARNSVTLQMNSLRAGDTALYFCARAELLDSGGYYLYYFDHWGQGTLVTVSS

SEQ ID NO: 620 - protein, 107 aa, Artificial Sequence
  Description of Artificial Sequence: Synthetic light chain variable region amino acid sequence
DIRMTQSPSSLSASVGDRVTITCRASQIIASYVNWYQKKPGKAPKVLIYAASRLQNGVPSRFSGSGSGTEFTLTISSLQPEDFATYYCQQSYSTSFTFGQGTKVDIK

SEQ ID NO: 621 - protein, 124 aa, Artificial Sequence
  Description of Artificial Sequence: Synthetic heavy chain variable region amino acid sequence
EVQLVESGGGLVQPGGSLRLSCSASGFTFRTYVMQWVRQAPGKGLEYVSAISSDGGSTDYADSVKGRFTVSRDNSKNTLYLQMSSLRAEDTAVYYCVKRGEGGNDYLYYYMDVWGKGTTVTVSS

SEQ ID NO: 622 - protein, 107 aa, Artificial Sequence
  Description of Artificial Sequence: Synthetic light chain variable region amino acid sequence
DIQVTQSPSSLSASVGDRVTITCRASQSITNYLNWYQQKPGKAPKVLIYAASSLQSGVPSRFSGSGSGTDFTLTISSLQPEDFATYYCQQSYLRPPTFGGGTKVEIK

SEQ ID NO: 623 - protein, 121 aa, Artificial Sequence
  Description of Artificial Sequence: Synthetic heavy chain variable region amino acid sequence
EVQLVESGGEVKKPGASVKVSCKASGYIFSNHGVSWVRQAPGQGLEWMGWISAYNGNAIYAQNLQGRVTLTTDTSTSTAYMELTSLTSDDTAIYYCARESGATAAAVMDYWGQGTLVTVSS

SEQ ID NO: 624 - protein, 112 aa, Artificial Sequence
  Description of Artificial Sequence: Synthetic light chain variable region amino acid sequence
DIVLTQTPLSLPVILGQPASISCRSSQSLVYSDGNTYLTWFQQRPGQSPRRLIYKVSNRDSGVPDRFSGSGSDTDFTLKISRVEAEDVGVYYCMQGIDWPRTFGQGTKVDIK

SEQ ID NO: 625 - protein, 133 aa, Artificial Sequence
  Description of Artificial Sequence: Synthetic heavy chain variable region amino acid sequence
EVQLLESGGGLVQPGGSLRLSCAASGFTFSSYAMNWVRQAPGKGLEWVSGISGSGESTYYADSVKGRFTISRDSSKNTVYLQMNSLRADDTAVYYCAKDQGYGVVVPAATRALPPRRYGMDVWGQGTTVTVSS

SEQ ID NO: 626 - protein, 109 aa, Artificial Sequence
  Description of Artificial Sequence: Synthetic light chain variable region amino acid sequence
EIVLTQSPGTLSLSPGERATLSCRASQSVSSTYLAWYQQKPGQAPRLLIYGASSRATGIPDRFSGSGSGTDFTLTITRLEPEDFAVYYCQQYGSSPPLTFGGGTKVDIK

SEQ ID NO: 627 - protein, 120 aa, Artificial Sequence
  Description of Artificial Sequence: Synthetic heavy chain variable region amino acid sequence
QVQLQESGPGLVKPSGTLSLTCVVSGGSIKSHNYWTWVRQPPGKGLEWVGEIYQSGRTNYNPSLNSRVTLSMDKSKNQLSLRLTSVTAADTAVYFCVGGGPFAPYYFQTWGQGTLVTVSS

SEQ ID NO: 628 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYNNNNRPSGVPDRFSGSKSGTSASLAITGLQAEDEADYYCQSYDTSLSGYVFGTGTKVTVL

SEQ ID NO: 629 - protein, 121 aa, Artificial Sequence
  Description of Artificial Sequence: Synthetic heavy chain variable region amino acid sequence
EVQLVESGAEVRKPGASVKVSCKASGYTFSSNAISWVRQAPGQGLEWMGYISVFNGNTKYAQNLQGRVTMTTDTATSTVYMELRSLRYDDTAIYYCARESLGMGGFYFDHWGQGTLVTVSS

SEQ ID NO: 630 - protein, 107 aa, Artificial Sequence
  Description of Artificial Sequence: Synthetic light chain variable region amino acid sequence
SYELTQPPSVSVAPGQTARITCGANNIGSDSVHWYQQKPGQAPVLVVFDDRDRPSGIPERFSGSNSGNTATLTISRVEAGDEADYYCQVWMTSDRSVFGGGTKLTVL

SEQ ID NO: 631 - protein, 124 aa, Artificial Sequence
  Description of Artificial Sequence: Synthetic heavy chain variable region amino acid sequence
EVQLVESGGGLVQPGGSLRLSCAASGFTFSRYAMGWVRQAPGKGLEWVSTISDSGGSTFYADSVEGRFTIARDSSKNTLSLHMNSLRAEDTAIYYCAREAYSSSWYSGGWFDRWGQGTLVTVSS

SEQ ID NO: 632 - protein, 108 aa, Artificial Sequence
  Description of Artificial Sequence: Synthetic light chain variable region amino acid sequence
ETTLTQSPATLSVSPGERATLSCRASQSVSSNLAWYQQKPGQAPRLLIYGASTRATGIPARFSGSGSGAEFTLTINSLQSEDFAIYYCQQYNNWPQYTFGQGTKVDIK

SEQ ID NO: 633 - protein, 125 aa, Artificial Sequence
  Description of Artificial Sequence: Synthetic heavy chain variable region amino acid sequence
EVQLVESGGGVVQPGKSLRLSCAVSGFTFSDHDMHWVRQAPGKGLEWVAAIWSDRTTKYYGDFVKGRFTISRDNSKNTLYLQMNSLRAEDTAVYYCARGQIYKSGGYYLVHLDHWGQGTLVTVSS

SEQ ID NO: 634 - protein, 108 aa, Artificial Sequence
  Description of Artificial Sequence: Synthetic light chain variable region amino acid sequence
DIQVTQSPSSLSASVGDRVTITCRASQSIASYLNWYQQKPGKAPNLLIYAASNLQSEVPSRFSGSGSGTDFTLTISGLQPEDFATYYCQQSYNIRLLTFGGGTKVEIK

SEQ ID NO: 635 - protein, 123 aa, Artificial Sequence
  Description of Artificial Sequence: Synthetic heavy chain variable region amino acid sequence
QVQLVQSGGGLVKPGGSLRLSCEASGFNFRSYHMSWVRQAPGKGLEWVSSITAGSSYINYADSVKGRFTISRDNAKNSVFLQMNSLSAEDTAVYYCAREGLNMGVGGTWFDPWGQGTLVTVSS

SEQ ID NO: 636 - protein, 112 aa, Artificial Sequence
  Description of Artificial Sequence: Synthetic light chain variable region amino acid sequence
QAVVTQEPSVSGAPGQRVTISCTGSSSNIGAGYDVHWYQQLPGTAPKLLIYGNNNRPSGVPDRFSGSKSATSASLAITGLQADDEADYYCQSYDRSLSGSWVFGTGTKVTVL

SEQ ID NO: 637 - protein, 130 aa, Artificial Sequence
  Description of Artificial Sequence: Synthetic heavy chain variable region amino acid sequence
EVQLVESGGGLVRPGRSLRLSCAASGFTFSMFSMNWVRQAPGKGLEWLAYIGGSGSTIDYANSVSGRFTISRDNAKNSLYLQMNSLRDEDTAVYYCARIGLQTYNSHSSSSSPARAFDVWGQGTTVTVSS

SEQ ID NO: 638 - protein, 107 aa, Artificial Sequence
  Description of Artificial Sequence: Synthetic light chain variable region amino acid sequence
DIVLTQSPSSLSASVGDRVTITCRASQSIGRFLNWYQQKPGKAPKLLIYAASSLESGVPSRFSGSGSGTQFSLTISSLQPEDFTTYYCQQSYSTPTTFGGGTKVDIK

SEQ ID NO: 639 - protein, 121 aa, Artificial Sequence
  Description of Artificial Sequence: Synthetic heavy chain variable region amino acid sequence
EVQLVESGGGLVKPGGSLRLSCAASGFSFSNYYMSWVRQAPGKGLEWISYISGGSTYANLADSVKGRFTISRDNTKNSMYLQMTSLRPDDTAVYYCARIHGTHGPFYFDYWGQGTLVTVSS

SEQ ID NO: 640 - protein, 112 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIHANSNRPSGVPDRFSGSKSGTSASLAITGLQAEDEADYYCQSYDNSLNAYYVFGTGTKLTVL

SEQ ID NO: 641 - protein, 125 aa, Artificial Sequence
  Description of Artificial Sequence: Synthetic heavy chain variable region amino acid sequence
EVQLVESGGGLVRPGGSLRLSCAASGFTFSSYAMDWVRQAPGKGLEWVSSISASSSFISYTDSVKGRFTISRDNAKNSLFLQMDNVTAEDTAVYYCARDYYESGRYFYGNPFDIWGQGTMVTVSS

SEQ ID NO: 642 - protein, 112 aa, Artificial Sequence
  Description of Artificial Sequence: Synthetic light chain variable region amino acid sequence
QPVLTQPPSVSGAPGQRVTISCTGSGSNIGAGFDVHWYQQLPGTAPKLLIYANSDRPSGVPDRFSASKSGTSASLAITGLQAEDEAHYYCQSYDNSLGGLCVFGTGTKLTVL

SEQ ID NO: 643 - protein, 124 aa, Artificial Sequence
  Description of Artificial Sequence: Synthetic heavy chain variable region amino acid sequence
QVQLVESGGGLVKPGGSLRLSCVVSGFTFRDYYMSWIRQAPGKGLEWISYISPSSTYTNYADSVRGRFTISRDNAENSLYLQMNSLRAEDTAVYYCARVNIAATGAGGVFLDYWGQGTTVTVSS

SEQ ID NO: 644 - protein, 112 aa, Artificial Sequence
  Description of Artificial Sequence: Synthetic light chain variable region amino acid sequence
QPVLTQPPSVSGAPGQRVTISCAGSSSNIGAGYDVHWYQQLPGTAPKLLIYGNINRPSGVPDRFSGSKSGTSASLAITGLQAEDEADYYCQSYDSSLSGSYVFGTGTKVTVL

SEQ ID NO: 645 - protein, 120 aa, Artificial Sequence
  Description of Artificial Sequence: Synthetic heavy chain variable region amino acid sequence
EVQLVESGGGLVKPGGSLRLSCAASGFRLSDYYMSWIRQAPGKGLEWISDISGGSTYTNYADSVKGRLTISRDNAQNSLYLQMNSLRAEDTAVYYCARWGSGGPDAFHFWGQGTTVTVSS

SEQ ID NO: 646 - protein, 112 aa, Artificial Sequence
  Description of Artificial Sequence: Synthetic light chain variable region amino acid sequence
QSVLTQPPSVSGVPGQRVTISCTGSRSNIGAGYDVHWYRQLPGTAPKLLIYGNSNRPSGVPDRFSGSKSGTSASLAITGLQADDEADYYCQSYDSSLSGSVIFGGGTKVTVL

SEQ ID NO: 647 - protein, 125 aa, Artificial Sequence
  Description of Artificial Sequence: Synthetic heavy chain variable region amino acid sequence
EVQLLESGGGLVKPGGSLRLSCAASGFTFSDYYMSWIRQAPGKGLEWVSNISGGSTYTNYADSVKGRFTISRDNAKNSLYLQMNSLRAEDTAVYYCAREAYGSGNYYNPNWLDPWGQGTLVTVSS

SEQ ID NO: 648 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNRNRPSGVPDRFSGSKSGTSASLAITGLQAEDEADYYCQSYDSSLSGSVFGGGTKLTVL

SEQ ID NO: 649 - protein, 120 aa, Artificial Sequence
  Description of Artificial Sequence: Synthetic heavy chain variable region amino acid sequence
EVQLLESGGGLVKPGGSLRLSCEVSGFRLSDYYMSWIRQAPGKGLEWVSHISGGSTYTNYADSVKGRFTISRDNGKKSMYLQMNSLRAEDTALYYCAKWGSGGPEAFDIWGRGTMVTVSS

SEQ ID NO: 650 - protein, 112 aa, Artificial Sequence
  Description of Artificial Sequence: Synthetic light chain variable region amino acid sequence
QSALIQPPSVSGAPGQRVTISCTGSSSNIGAGYDVHWYQQIPGTAPKLLIYGNNNRPSGVPDRFSGSKSGTSASLAITGLQAEDEADYYCQSYDNSLSGSVVFGGGTKLTVL

SEQ ID NO: 651 - protein, 123 aa, Artificial Sequence
  Description of Artificial Sequence: Synthetic heavy chain variable region amino acid sequence
EVQLLESGGGLVKPGGSLRLSCAASRFAFSNYYMTWIRQAPGKGLEWISNISGGSTFTNYADSVKGRFTISRDNAKNSVHLQMNSLRAEDTAVYYCVREASVAAGTPEGFDIWGQGTMVTVSS

SEQ ID NO: 652 - protein, 111 aa, Artificial Sequence
  Description of Artificial Sequence: Synthetic light chain variable region amino acid sequence
QSVLTQPPSVSGAPGQRVIISCTGSSSNIGAGYDVNWYQQLPGTAPKLLMYGNRNRASGVPDRFSGSKSGTSASLAITGLQAEDEADYYCHSYDSSLGGSVFGGGTKLTVL

SEQ ID NO: 653 - protein, 124 aa, Artificial Sequence
  Description of Artificial Sequence: Synthetic heavy chain variable region amino acid sequence
EVQLVESGGGLVKPGGSLKLSCVASGLKFSSYSMNWVRQAPGKGLEWVSSVSAGSSYTNYADSVKGRFTISRDNAKNSLYLQMNSLRVDDTAVYYCATERCSGGSCYLHGFDPWGQGTTVTVSS

SEQ ID NO: 654 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIFDNIIRPSGVPDRFSGSKSGTSASLAITGLQADDEADYYCQSYDKSGDYVFGTGTKVTVL

SEQ ID NO: 655 - protein, 120 aa, Artificial Sequence
  Description of Artificial Sequence: Synthetic heavy chain variable region amino acid sequence
QVQLQESGPGLVKPSGTLSLTCAVSGDSITTSNWWSWVRQPPGKGLEWIGEIYHSGVTRYNPSLKSRLSISLDKSRNQFSLKLSSVTAADTAVYYCARDEALFGHWFDPWGQGTLVTVSS

SEQ ID NO: 656 - protein, 109 aa, Artificial Sequence
  Description of Artificial Sequence: Synthetic light chain variable region amino acid sequence
QSVLTQPRSVSGSPGQSVTISCTGSSSDIGSYNYVSWYQQHPGKAPKLMLYDVSKRPSGVPDRFSGSKSVKTASLTISGLQAEDEADYYCCTYAGNSVVFGGGTKLTVL

SEQ ID NO: 657 - protein, 121 aa, Artificial Sequence
  Description of Artificial Sequence: Synthetic heavy chain variable region amino acid sequence
EVQLVESGAEVKKPGASVTVSCKASGYTFTSNTISWLRQAPGQGLEWLGWVSASNGNTKYAQKFQGRVTMTTDTSATTAYMEVRTLRHDDTAIYYCARDILDMGGFHFDNWGQGTLVTVSS

SEQ ID NO: 658 - protein, 108 aa, Artificial Sequence
  Description of Artificial Sequence: Synthetic light chain variable region amino acid sequence
SYVLTQPPSVSVAPGQTARITCGGNNIGNKHVHWYKQKPGQAPVLVVYDDSDRPSGIPERFSGSNSGNTATLTVSRVEAGDEADFYCQVWDNTNDHPVFGGGTKVTVL

SEQ ID NO: 659 - protein, 120 aa, Artificial Sequence
  Description of Artificial Sequence: Synthetic heavy chain variable region amino acid sequence
EVQLVETGGGLVKPGGSLRLSCEASGFNFRSYSMNWVRQAPGKGLEWVSSISASSSYINYADSVKGRFTISRDNSKNSLYLQMNSLRAEDTGVYYCARVLVHYYYGMDVWGQGTTVTVSS

SEQ ID NO: 660 - protein, 110 aa, Artificial Sequence
  Description of Artificial Sequence: Synthetic light chain variable region amino acid sequence
QSVLTQPPSVSAAPGQRVTISCTGTSSNIGAGYDVHWYQQLPGRAPKLLILGNNNRPSGVPDRFSGSKSGTSASLAITGLQAEDEADYYCQTYDKTLMEIFGGGTKLTVL

SEQ ID NO: 661 - protein, 123 aa, Artificial Sequence
  Description of Artificial Sequence: Synthetic heavy chain variable region amino acid sequence
EVQLVETGGGLVKPGGSLRLSCAASPFAFSNYYMSWIRQAPGKGLEWISNISGGSTFTNYADSVKGRFTISRDNARNSLYLLMNNLRTEDTAVYYCAREASVAAGTPEGFDVWGQGTTVTVSS

SEQ ID NO: 662 - protein, 111 aa, Artificial Sequence
  Description of Artificial Sequence: Synthetic light chain variable region amino acid sequence
QSVVTQPPSVSGAPGQRVTISCTGSSSNIGAGYDVNWYQQFPGTAPKLLIYGNRNRPSGVPARFSGSKSGASASLAITGLQAEDEADYYCHSYDSGLSGSVFGGGTKLTVL

SEQ ID NO: 663 - protein, 118 aa, Artificial Sequence
  Description of Artificial Sequence: Synthetic heavy chain variable region amino acid sequence
EVQLVESGGGLVQPGGSLRLSCAASGFTFSGYEMNWVRQAPGKGLEWLSYISSSGGIIYYADSVKGRFTISRDNARNSLFLQMNSLRAEDTAVYSCARARLLDGFDIWGQGTMVTVSS

SEQ ID NO: 664 - protein, 107 aa, Artificial Sequence
  Description of Artificial Sequence: Synthetic light chain variable region amino acid sequence
DIQVTQSPSTLSASVGDRVTITCRASQSIGSWLAWYQQKPGKAPKLLIYKASSLESGVPSRFSGSGSGTEFTLTISSLQPDDFATYYCQQYNSYSYTFGQGTKVEIK

SEQ ID NO: 665 - protein, 125 aa, Artificial Sequence
  Description of Artificial Sequence: Synthetic heavy chain variable region amino acid sequence
EVQLLESGGGLVKPGGSLRLSCVASGFRFTSYSMNWVRQAPGKGLEWVSSISASSSYVDYADSLKGRFTISRDNAQNSLFLQMNSLRAEDTAVYYCARDYYDSGNYHSPFPMDVWGQGTTVTVSS

SEQ ID NO: 666 - protein, 108 aa, Artificial Sequence
  Description of Artificial Sequence: Synthetic light chain variable region amino acid sequence
QSVLTQPPSVSGAPGQRVTISCTGSRSNIGAGYDVHWYQQLPGTAPKLLIYGNNKRPSGVPDRFSGSKSGTSASLAITGLQAEDEADYYCQSYDSGPIFGGGTKVTVL

SEQ ID NO: 667 - protein, 125 aa, Artificial Sequence
  Description of Artificial Sequence: Synthetic heavy chain variable region amino acid sequence
EVQLLESGGGLVKPGGSLRLSCAASGFTSGFTFSDFYMSWIRLTPGKGLEWISYISTHSTSTNYADSVRGRFIISRDDARNSLFLQMNSLRAEDTAVYYCAGYYYGSGSYFFDHWGQGTLVTVSS

SEQ ID NO: 668 - protein, 106 aa, Artificial Sequence
  Description of Artificial Sequence: Synthetic light chain variable region amino acid sequence
ETTLTQSPATLSVSPGERATLSCRASQSVSSNVAWYQQKPGQAPRLLIYSASSRDTGIPVRFSGSGSGTEFTLSISSLQSEDFAVYYCQQYSDWPTFGQGTKVEIK

SEQ ID NO: 669 - protein, 120 aa, Artificial Sequence
  Description of Artificial Sequence: Synthetic heavy chain variable region amino acid sequence
QVQLVQSGAEVKKPGESLRISCQYSAYGFSTYWISWVRQLPGKGLEWMGRIDPSDSHTTYSPSFQGHVTLSADKSISTVYLQWSSLKASDTAMYYCARHQEYSGSDLDSWGQGTLVTVSS

SEQ ID NO: 670 - protein, 109 aa, Artificial Sequence
  Description of Artificial Sequence: Synthetic light chain variable region amino acid sequence
QPVLTQPPSVSAAPGQRVTISCSGTRSNIGYNFVSWYQQLPGTAPKLLIYDNNKRPSGIPDRFSGSKSGTSATLAITGLQTGDEADYYCGTWDSSLSALFGGGTKVTVL

SEQ ID NO: 671 - protein, 121 aa, Artificial Sequence
  Description of Artificial Sequence: Synthetic heavy chain variable region amino acid sequence
EVQLLESGGGVVQPGRSLRLSCVASGFTFSTYGVHWVRQAPGKGLEWVAVISYDGANKDYADSVKGRFTISRDNSKNTLYLQMNSLRAEDTAVYYCAKMITRVLPGGFDRWGQGTLVTVSS

SEQ ID NO: 672 - protein, 108 aa, Artificial Sequence
  Description of Artificial Sequence: Synthetic light chain variable region amino acid sequence
EIVMTQSPGTLSLSPGERATLSCRASQSVSSAYLAWYQQKPGQAPRLLIYDASRRATGIPDRFSGSGSGTDFTLTISRLEPEDFAVYYCQQYGSSRFTFGQGTKVEIK

SEQ ID NO: 673 - protein, 121 aa, Artificial Sequence
  Description of Artificial Sequence: Synthetic heavy chain variable region amino acid sequence
EVQLLESGAEVKKPGASVKVSCKASGYTFSNYGISWVRQAPGQGLEWMGWISVYNGNTEYAQKFQGRLTMTTDTSTSTAYMELRSLRSDDTAVYYCARDPPAVAASFMDVWGQGTTVTVSS

SEQ ID NO: 674 - protein, 112 aa, Artificial Sequence
  Description of Artificial Sequence: Synthetic light chain variable region amino acid sequence
EIVLTQSPLSLPVTLGQPASISCRSSQSLVHSEGNTYLSWFQQRPGQSPRRLIYKVSNRDSGVPDRFSGSGSGTDFTLKISRVEAEDVGLYFCMQGTHWPPTFGGGTKVEIK

SEQ ID NO: 675 - protein, 124 aa, Artificial Sequence
  Description of Artificial Sequence: Synthetic heavy chain variable region amino acid sequence
QVQLVESGGGLVKPGGSLRLSCAASGFSISSYSMNWVRQAPGKGLEWVSSISGSSSYIYYGDSVKGRFTISRDNARNSLYLQMNSLRAEDTAVYYCARGDIAAAGTITYYFAHWGQGTLVTVSS

SEQ ID NO: 676 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLTGTAPKLLIFGNNNRPSGVPDRFSGSKSGTSASLAITGLQAEDEADYYCQSYDSSLSGAVFGGGTQLTVL

SEQ ID NO: 677 - protein, 123 aa, Artificial Sequence
  Description of Artificial Sequence: Synthetic heavy chain variable region amino acid sequence
EVQLLESGGGLVKPGGSLRLSCAASGFSFSSYTMNWVRQAPGKGLEWVSSITGGSSYIDYAGSLKGRFTISRDNAKNSLYLQMNSLRVEDTAVYYCARDFPNIAVGGKTLDYWGQGTLVTVSS

SEQ ID NO: 678 - protein, 110 aa, Artificial Sequence
  Description of Artificial Sequence: Synthetic light chain variable region amino acid sequence
QPVLTQPPSVSGAPGQRVTISCTGSSSNIGAGYDVHWFQQLPGTAPKLLIYVNNNRPSGVPDRFSGSKSGTSASLAITGLQAEDEADYYCQSYDRLSAVVFGGGTKVTVL

SEQ ID NO: 679 - protein, 121 aa, Artificial Sequence
  Description of Artificial Sequence: Synthetic heavy chain variable region amino acid sequence
EVQLVESGGGLVQPGRSLRLSCVASGFTFDDYAMHWVRQAPGKGLEWVSGINWNSGGIGYADSVKGRFTISRDNTKNSLYLQMNSLRAEDTALYYCAKDGSALMGYGVEVWGQGTTVTVSS

SEQ ID NO: 680 - protein, 110 aa, Artificial Sequence
  Description of Artificial Sequence: Synthetic light chain variable region amino acid sequence
SYELTQPPSASGTPGQRVTISCSGSNSNIGNNYVYWYQQLPGTAPKLLIYRNNQWPSGVPDRFSASKSGTSASLAISGLRSEDEADYYCASWDDSLSALVFGGGTKLTVL

SEQ ID NO: 681 - protein, 124 aa, Artificial Sequence
  Description of Artificial Sequence: Synthetic heavy chain variable region amino acid sequence
EVQLVESGPGLVKPSQTLSLTCAISGDSVSSNSVAWNWIRQSPSRGLEWLGRTYYQSKWYNDYAVSVKSRISVNPDTSKNQFSLQLNSLTPEDTAVYYCVRGCSWGFGWYFDLWGRGTLVTVSS

SEQ ID NO: 682 - protein, 111 aa, Artificial Sequence
  Description of Artificial Sequence: Synthetic light chain variable region amino acid sequence
QSVLTQPPSVSGAPGQRVTISCTGSSSNIGAIYDVHWYQQFPGTAPKLLIYGNTNRPSGVPDRFSGSKSGTSASLAITGLQAEDEADYYCQSYDSSLSGYVFGTGTKVTVL

SEQ ID NO: 683 - protein, 125 aa, Artificial Sequence
  Description of Artificial Sequence: Synthetic heavy chain variable region amino acid sequence
EVQLVESGGGLIQPGGSLRLSCAASGFTFSTYEMNWVRQAPGKGLEWVSSISTSGSTKDYAGSVKGRFTVSRDNAKNSLYLQMNSLRAEDTAIYYCARVYYYDSSGYYLALFDYWGQGTLVTVSS

SEQ ID NO: 684 - protein, 108 aa, Artificial Sequence
  Description of Artificial Sequence: Synthetic light chain variable region amino acid sequence
EIVLTQSPSSLSASVGDRVTITCRASQSIASYLNWYQQKPGKAPKLLIYAASSLRSGVPSRFSGSGSGTDFTLTISSLQPEDFATYYCQQSYSTPSLTFGGGTKLEIK

SEQ ID NO: 685 - protein, 125 aa, Artificial Sequence
  Description of Artificial Sequence: Synthetic heavy chain variable region amino acid sequence
QVQLVESGPGLVRPSGTLSLTCAVSGGSISGKNWWSWVRQPPGKGLEWIGEIDHSGSTNYNPSLKSRVTISVDKSKNQFSLKLSSVTAADTAVYYCARTGLYDSSGYYLYYFNYWGQGTLVTVSS

SEQ ID NO: 686 - protein, 107 aa, Artificial Sequence
  Description of Artificial Sequence: Synthetic light chain variable region amino acid sequence
EIVMTQSPSSLSASVGDRVTISCRASQTIASYVNWYQQRPGKAPNLLIFAASNLQTGVPSRFRGSGSGTVFTLTISSLQPEDFATYYCQQSYSTPRTFGQGTKVDIK

SEQ ID NO: 687 - protein, 119 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRGDGYNYDYWGQGTLVTVSS

SEQ ID NO: 688 - protein, 110 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVVFGGGTKVTVL

SEQ ID NO: 689 - protein, 123 aa, Artificial Sequence
  Description of Artificial Sequence: Synthetic heavy chain variable region amino acid sequence
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGRFSLSHTYYFDYWGQGTLVTVSS

SEQ ID NO: 690 - protein, 111 aa, Artificial Sequence
  Description of Artificial Sequence: Synthetic light chain variable region amino acid sequence
QPVLTQPPSASGSPGQSVTISCTGTSSDVGGYNYVSWYQQHPGKAPKLMIYEVSKRPSGVPNRFSGSKSGNTASLTVSGLQAEDEADYYCSSYAGSNNLYVFGTGTKVTVL

SEQ ID NO: 691 - protein, 119 aa, Artificial Sequence
  Description of Artificial Sequence: Synthetic heavy chain variable region amino acid sequence
QVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREANWGVAFDIWGQGTMVTVSS

SEQ ID NO: 692 - protein, 110 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSYVFGTGTKVTVL

SEQ ID NO: 693 - protein, 125 aa, Artificial Sequence
  Description of Artificial Sequence: Synthetic heavy chain variable region amino acid sequence
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCAKSYIYDSSGYYLYYFDYWGQGTLVTVSS

SEQ ID NO: 694 - protein, 107 aa, Artificial Sequence
  Description of Artificial Sequence: Synthetic light chain variable region amino acid sequence
EIVMTQSPSSLSASVGDRVTITCRASQSISSYLNWYQQKPGKAPKLLIYAASSLQSGVPSRFSGSGSGTDFTLTISSLQPEDFATYYCQQSYSTPGTFGQGTKVDIK

SEQ ID NO: 695 - protein, 122 aa, Artificial Sequence
  Description of Artificial Sequence: Synthetic heavy chain variable region amino acid sequence
QVQLVQSGGGLVQPGGSLRLSCAASGFTFSDHYMDWVRQAPGKGLEWVGRTRNKANSYTTEYAASVKGRFTISRDDSKNSLYLQMNSLKTEDTAVYYCARVGYYYYYGMDVWGQGTTVTVSS

SEQ ID NO: 696 - protein, 106 aa, Artificial Sequence
  Description of Artificial Sequence: Synthetic light chain variable region amino acid sequence
SYVLTQPPSVSVSPGQTASITCSGDKLGDKYACWYQQKPGQSPVLVIYQDSKRPSGIPERFSGSNSGNTATLTISGTQAMDEADYYCQAWDSSTPLFGGGTKVTVL

SEQ ID NO: 697 - protein, 121 aa, Artificial Sequence
  Description of Artificial Sequence: Synthetic heavy chain variable region amino acid sequence
QVTLKESGPALVKPTQTLTLTCTFSGFSLSTSGMCVSWIRQPPGKALEWLALIDWDDDKYYSTSLKTRLTISKDTSKNQVVLTMTNMDPVDTATYYCARSPGRAVAGTDYWGQGTLVTVSS

SEQ ID NO: 698 - protein, 107 aa, Artificial Sequence
  Description of Artificial Sequence: Synthetic light chain variable region amino acid sequence
SYELTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVL

SEQ ID NO: 699 - protein, 120 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDYSSGWYYFDYWGQGTLVTVSS

SEQ ID NO: 700 - protein, 111 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVL

SEQ ID NO: 701 - protein, 124 aa, Artificial Sequence
  Description of Artificial Sequence: Synthetic heavy chain variable region amino acid sequence
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAVEQQLFIWYYGMDVWGQGTTVTVSS

SEQ ID NO: 702 - protein, 107 aa, Artificial Sequence
  Description of Artificial Sequence: Synthetic light chain variable region amino acid sequence
SYELIQPPSVSVSPGQTASITCSGDKLGDKYACWYQQKPGQSPVLVIYQDSKRPSGIPERFSGSNSGNTATLTISGTQAMDEADYYCQAWDSSTDVVFGGGTQLTVL

SEQ ID NO: 703 - protein, 125 aa, Artificial Sequence
  Description of Artificial Sequence: Synthetic heavy chain variable region amino acid sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARESALSRDGYNYGDVDYWGQGTLVTVSS

SEQ ID NO: 704 - protein, 112 aa, Artificial Sequence
  Description of Artificial Sequence: Synthetic light chain variable region amino acid sequence
ETTLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPTFGQGTKLEIK

SEQ ID NO: 705 - protein, 123 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCAREGASGYNYRYYFDYWGQGTLVTVSS

SEQ ID NO: 706 - protein, 112 aa, Artificial Sequence
  Description of Artificial Sequence: Synthetic light chain variable region amino acid sequence
QSVLTQPPSVSGAPGQRVTISCTGSSSNIGAGYDVHWYQQFPGAAPKLLIYGNNNRPSGVPDRFSGSKSGTSASLAITGLQADDEADYYCQSYDSSLSGYVVFGGGTKLTVL

SEQ ID NO: 707 - protein, 120 aa, Artificial Sequence
  Description of Artificial Sequence: Synthetic heavy chain variable region amino acid sequence
EVQLLESGGGVVQPGRSLRLSCAASGFTFSDYGMHWVRQAPGKGLEWVAVIWYDGSYKYYADSVKGRFTISRDNSKNTLFLQMNSLRAEDTAVYYCARESLQTHDAFDIWGQGTMVTVSS

SEQ ID NO: 708 - protein, 108 aa, Artificial Sequence
  Description of Artificial Sequence: Synthetic light chain variable region amino acid sequence
DIQMTQSPSSLSASVGDRVTITCRASQGISNSLAWYQQKPGKAPKLLLYAASRLESGVPSRFSGSGSGTDYTLTINSLQPEDFATYFCQQYYSTLTWTFGQGTKVDIK

SEQ ID NO: 709 - protein, 122 aa, Artificial Sequence
  Description of Artificial Sequence: Synthetic heavy chain variable region amino acid sequence
EVQLLESGGGLVKPGGSLRLSCAASGFTFSDYYMSWIRQAPGKGLEWVSYISSSGSTIYYADSVKGRFTISRDNAKNSLYLQMNSLRAEDTAVYYCAREIGGSYTGGAFDIWGQGTMVTVSS

SEQ ID NO: 710 - protein, 108 aa, Artificial Sequence
  Description of Artificial Sequence: Synthetic light chain variable region amino acid sequence
SYELTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKVTVL

SEQ ID NO: 711 - protein, 120 aa, Artificial Sequence
  Description of Artificial Sequence: Synthetic heavy chain variable region amino acid sequence
QVQLVQSGAEVKRPGASVKVSCKASEYTFNFHDINWVRQAPGQGLEWMGWMNPKSGNTGYAQKFQGRVTMTRDTSKNTAYLELSSLRSEDTAVYYCARGYGTSWSSDSWWGQGTLVTVSS

SEQ ID NO: 712 - protein, 109 aa, Artificial Sequence
  Description of Artificial Sequence: Synthetic light chain variable region amino acid sequence
SYELTQLPSVSVSPGQTARITCSGDALSKQFVYWYQQKPGLAPMLVIYKDTNRPSWIPERFSGSGSGTTATLTISEVQAEDEADYYCQSVDNSGTYGWVFGGGTKVTVL

SEQ ID NO: 713 - protein, 124 aa, Artificial Sequence
  Description of Artificial Sequence: Synthetic heavy chain variable region amino acid sequence
EVQLVESGPGLVKPSETLSLTCTVSGGSINSYSWTWIRQPPGKGLEWLGSFDYSGSNTYNPSLKSRVTIAVDTSKNQFSLKLTSATAADTAVYYCARAPVYDSSGYYLYYFDNWGQGTLVTVSS

SEQ ID NO: 714 - protein, 108 aa, Artificial Sequence
  Description of Artificial Sequence: Synthetic light chain variable region amino acid sequence
DIQMTQSPSSLSASVGDRVTITCRASQSIASYLNWYQQKPGKAPKLLIFAASNLHSGVPSRFSGSGSGTTFTLTISSLQPEDFATYYCQQSYSIRFFTFGPGTKLEIK

SEQ ID NO: 715 - protein, 124 aa, Artificial Sequence
  Description of Artificial Sequence: Synthetic heavy chain variable region amino acid sequence
QVQLQQWGAGLLKPSETLSLTCAVYGGSFSDYSWTWIRQPPGKGLEWIGEISHTGITNYNPSLKSRVNISVDTSKNQFSLKLSSVTAADTAVYYCARADAYDSSGYYVYYFDYWGQGTLVTVSS

SEQ ID NO: 716 - protein, 107 aa, Artificial Sequence
  Description of Artificial Sequence: Synthetic light chain variable region amino acid sequence
DIQVTQSPPSLSASVGDRVTITCRASQTIASYLNWYHQKPGKAPELLIYAASSLQSGVPSRFSGSGSGTAFTLTISSLQPEDFATYYCQQSYSAPPSFGQGTKVEIK

SEQ ID NO: 717 - protein, 124 aa, Artificial Sequence
  Description of Artificial Sequence: Synthetic heavy chain variable region amino acid sequence
EVQLVESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRGRQYSYGYYYFDYWGQGTLVTVSS

SEQ ID NO: 718 - protein, 110 aa, Artificial Sequence
  Description of Artificial Sequence: Synthetic light chain variable region amino acid sequence
QSVLIQPASVSGSPGQSITISCTGTSSDVGGYNFVSWYQQHPGKAPKLMIYDVSNRPSGVSNRFSGSKSGNTASLTISGLQAEDEADYYCSSYTSSTLDVFGTGTKVTVL

SEQ ID NO: 719 - protein, 123 aa, Artificial Sequence
  Description of Artificial Sequence: Synthetic heavy chain variable region amino acid sequence
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARGGAVAGTRTGGFDIWGQGTTVTVSS

SEQ ID NO: 720 - protein, 108 aa, Artificial Sequence
  Description of Artificial Sequence: Synthetic light chain variable region amino acid sequence
SYELTQPPSVSVSPGQTARITCSGDALPKQYAYWYQQKPGQAPVLVIYKDSERPSGIPERFSGSSSGTTVTLTISGVQAEDEADYYCQSADSSGTYQVFGGGTKLTVL

SEQ ID NO: 721 - protein, 125 aa, Artificial Sequence
  Description of Artificial Sequence: Synthetic heavy chain variable region amino acid sequence
EVQLVESGGGLVKPGGSLRLSCAASGFIFSDYYMSWIRQAPGKGLEWVSNISGGSSFTNYADSVKGRFTISRDNAKNSLYLQMNSLRAEDTAVYYCARDLGYCSSNSCLDAFDIWGQGTTVTVSS

SEQ ID NO: 722 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNTNRPSGVPDRFSGSRSGTSASLAITGLQAEDEADYYCQSYDSSLSGSLFGGGTKVTVL

SEQ ID NO: 723 - protein, 118 aa, Artificial Sequence
  Description of Artificial Sequence: Synthetic heavy chain variable region amino acid sequence
QVQLVQSGAEVKKPGESLKISCKGSGYSFTSYWIGWVRQMPGKGLEWMGIIYPGDSDTRYSPSFQGQVTISADKSISTAYLQWSSLKASDTAMFYCVMGSYSYYFDYWGQGTLVTVSS

SEQ ID NO: 724 - protein, 110 aa, Artificial Sequence
  Description of Artificial Sequence: Synthetic light chain variable region amino acid sequence
NFMLTQPHSVSESPGKTVTISCTRSSGSIASNYVQWYQQRPGSAPTTVIYEDNLRPSGVPDRFSGSIDSSSNSASLTISGLKTEDEADYYCQSYDSSNQVFGGGTKLTVL

SEQ ID NO: 725 - protein, 121 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVGYSSSSGAFDYWGQGTLVTVSS

SEQ ID NO: 726 - protein, 111 aa, Artificial Sequence; identical to SEQ ID NO: 176
  Description of Artificial Sequence: Synthetic light chain variable region amino acid sequence

SEQ ID NO: 727 - protein, 127 aa, Artificial Sequence
  Description of Artificial Sequence: Synthetic heavy chain variable region amino acid sequence
QVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARTAYGSGSYPIYYYYYMDVWGKGTTVTVSS

SEQ ID NO: 728 - protein, 106 aa, Artificial Sequence
  Description of Artificial Sequence: Synthetic light chain variable region amino acid sequence
SYELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 729 - protein, 124 aa, Artificial Sequence
  Description of Artificial Sequence: Synthetic heavy chain variable region amino acid sequence
EVQLLESGPGLVKPSETLSLTCTVSGGSISSYYWSWIRQPPGKGLEWIGYIYYSGSTNYNPSLKSRVTISVDTSKNQFSLKLSSVTAADTAVYYCARILGHCSGGSCYRIIDYWGQGTLVTVSS

SEQ ID NO: 730 - protein, 106 aa, Artificial Sequence
  Description of Artificial Sequence: Synthetic light chain variable region amino acid sequence
QPVLTQPPSVSVSPGQTASITCSGDKLGDKYACWYQQKPGQSPVLVIYQDSKRPSGIPERFSGSNSGNTATLTISGTQAMDEADYYCQAWDSSTGVFGGGTKLTVL

SEQ ID NO: 731 - protein, 121 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREGRDGYNYYFDYWGQGTLVTVSS

SEQ ID NO: 732 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVL

SEQ ID NO: 733 - protein, 122 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARVRGGYSYGYGMDVWGQGTTVTVSS

SEQ ID NO: 734 - protein, 111 aa, Artificial Sequence
  Description of Artificial Sequence: Synthetic light chain variable region amino acid sequence
QSVVTQPPSVSGAPGQRVTISCTGSSSNIGAGFDVHWYQQLPGTAPKLLIYGNSNRPSGVPDQFSGSKSGTSASLAITGLQAEDEADYYCQSYDSSLSGVVFGGGTKLTVL

SEQ ID NO: 735 - protein, 128 aa, Artificial Sequence
  Description of Artificial Sequence: Synthetic heavy chain variable region amino acid sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVTARTFGGIRKGYYYGMDVWGQGTTVTVSS

SEQ ID NO: 736 - protein, 106 aa, Artificial Sequence
  Description of Artificial Sequence: Synthetic light chain variable region amino acid sequence
SYELTQPPSVSVSPGQTASITCSGDKLGDKYACWYQQKPGQSPVLVIYQDSKRPSGIPERFSGSNSGNTATLTISGTQVMDEADYYCQAWDSSTVVFGGGTKLTVL

SEQ ID NO: 737 - protein, 121 aa, Artificial Sequence
  Description of Artificial Sequence: Synthetic heavy chain variable region amino acid sequence
EVQLLESGGGLVLPGGSLRLSCAASGFTFSSYAMSWVRQAPGKGLEWVSAISGSGIYTYYADSVKGRFTISRDNSKNTLYLQMSSLRAEDTAVYYCAKGSLGMAYSAFDIWGLGTTVTVSS

SEQ ID NO: 738 - protein, 108 aa, Artificial Sequence
  Description of Artificial Sequence: Synthetic light chain variable region amino acid sequence
DIQLTQSPGTLSLSSGERATLSCRASQSVSSNYLAWYQQKPGQPPRLLIYGASSRATGIPDRFSGSGSGTDFTLTISRLEPEDFAVYYCQQYGSSPLTFGGGTKVDIK

SEQ ID NO: 739 - protein, 124 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCAREGYSSSSGYYYYMDVWGKGTTVTVSS

SEQ ID NO: 740 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVTVL

SEQ ID NO: 741 - protein, 130 aa, Artificial Sequence
  Description of Artificial Sequence: Synthetic heavy chain variable region amino acid sequence
EVQLVESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVNPYYDSSGTPYYYYGMDVWGQGTTVTVSS

SEQ ID NO: 742 - protein, 106 aa, Artificial Sequence
  Description of Artificial Sequence: Synthetic light chain variable region amino acid sequence
SYELTQPPSVSVSPGQTASITCSGDKLGDKYACWYQQKPGQSPVLVIYQDSKRPSGIPERFSGSNSGNTATLTISGTQAMDEADYYCQAWDSGTVVFGGGTKLTVL

SEQ ID NO: 743 - protein, 117 aa, Artificial Sequence
  Description of Artificial Sequence: Synthetic heavy chain variable region amino acid sequence
QVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCARGDPAANDYWGQGTLVTVSS

SEQ ID NO: 744 - protein, 110 aa, Artificial Sequence
  Description of Artificial Sequence: Synthetic light chain variable region amino acid sequence
QPVLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNVVFGGGTKLTVL

SEQ ID NO: 745 - protein, 122 aa, Artificial Sequence
  Description of Artificial Sequence: Synthetic heavy chain variable region amino acid sequence
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGLPGQWLEYYFDYWGQGTLVTVSS

SEQ ID NO: 746 - protein, 108 aa, Artificial Sequence
  Description of Artificial Sequence: Synthetic light chain variable region amino acid sequence
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPVFGGGTKVTVL

SEQ ID NO: 747 - protein, 123 aa, Artificial Sequence
  Description of Artificial Sequence: Synthetic heavy chain variable region amino acid sequence
EVQLVESGGGLVQPGGSLRLSCAASGFSFSTYAMSWVRQAPGKGLEWVSAISGGGGSTYYADSVKGRFTISRDNSKNTLYLQVNSLRAEDTAVYYCARGGYCSSDSCYPFDFWGQGTLVTVSS

SEQ ID NO: 748 - protein, 108 aa, Artificial Sequence
  Description of Artificial Sequence: Synthetic light chain variable region amino acid sequence
QPVLTQPPSVSVSPGQTAMITCSGDALPKQYAYWYQQKPGQAPVLVIYKDSERPSGIPERFSGSSSGTTVTLTISGVQAEDEADYYCQSADNSGSYAVFGGGTQLTVL

SEQ ID NO: 749 - protein, 123 aa, Artificial Sequence
  Description of Artificial Sequence: Synthetic heavy chain variable region amino acid sequence
EVQLLESGGGLVQPGRSLRLSCAASGFTFDDYAMHWVRQAPGKGLEWVSGISWNSGSIGYADSVKGRFTISRDNAKNSLYLQMNSLRAEDTALYYCAKDGDSSSWRDSNFDYWGQGTLVTVSS

SEQ ID NO: 750 - protein, 111 aa, Artificial Sequence; identical to SEQ ID NO: 272
  Description of Artificial Sequence: Synthetic light chain variable region amino acid sequence

SEQ ID NO: 751 - protein, 129 aa, Artificial Sequence
  Description of Artificial Sequence: Synthetic heavy chain variable region amino acid sequence
EVQLLESGGGVVQPGRSLRLSCAASGFTFNSYTMHWVRQAPGKGLEWVAVISYDGSNKYYADSVKGRFTISRDNSKNTLYLQMNSLRAEDTAVYYCARGRPYDFWSGYYTDYYYYMDVWGKGTTVTVSS

SEQ ID NO: 752 - protein, 107 aa, Artificial Sequence
  Description of Artificial Sequence: Synthetic light chain variable region amino acid sequence
EIVLTQSPGTLSLSPGERATLSCRASQSVYSNYLAWYQQKPGQAPRLLIYGASSRATGIPDRFSGSGSGTDFTLTISRLEPEDFAVYYCQQCGSSWTFGQGTKVEIK

SEQ ID NO: 753 - protein, 123 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAREGYSSSSGYYYMDVWGKGTTVTVSS

SEQ ID NO: 754 - protein, 111 aa, Artificial Sequence; identical to SEQ ID NO: 740
  Description of Artificial Sequence: Synthetic light chain variable region amino acid sequence

SEQ ID NO: 755 - protein, 121 aa, Artificial Sequence
  Description of Artificial Sequence: Synthetic heavy chain variable region amino acid sequence
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGIPGYYYYGMDVWGQGTTVTVSS

SEQ ID NO: 756 - protein, 106 aa, Artificial Sequence
  Description of Artificial Sequence: Synthetic light chain variable region amino acid sequence
SYELTQPPSVSVSPGQTASITCSGDKLGDKYACWYQQKPGQSPVLVIYQDSKRPSGIPERFSGSNSGNTATLTISGTQAMDEADYYCQAWDSSTYVFGTGTKVTVL

SEQ ID NO: 757 - protein, 123 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDSMALLYSNYWFDPWGQGTLVTVSS

SEQ ID NO: 758 - protein, 111 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVL

SEQ ID NO: 759 - protein, 118 aa, Artificial Sequence
  Description of Artificial Sequence: Synthetic heavy chain variable region amino acid sequence
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGGTGVEFDYWGQGTLVTVSS

SEQ ID NO: 760 - protein, 110 aa, Artificial Sequence
  Description of Artificial Sequence: Synthetic light chain variable region amino acid sequence
QPVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVFGGGTQLTVL

SEQ ID NO: 761 - protein, 120 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARESGSGWYYFDYWGQGTLVTVSS

SEQ ID NO: 762 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDGSLSGVFGGGTKVTVL

SEQ ID NO: 763 - protein, 119 aa, Artificial Sequence
  Description of Artificial Sequence: Synthetic heavy chain variable region amino acid sequence
QVQLVQSGAEVKKPGSSVKVSCKASGGTFSSYTISWVRQAPGQGLEWMGRIIPILGIANYAQKFQGRVTITADKSTSTAYMELSSLRSEDTAVYYCARDPPYLRAFDIWGQGTTVTVSS

SEQ ID NO: 764 - protein, 108 aa, Artificial Sequence
  Description of Artificial Sequence: Synthetic light chain variable region amino acid sequence
ETTLTQSPSSLSASVGDRVTITCRASQSISSYLNWYQQKPGKAPKLLIYAASSLQSGVPSRFSGSGSGTDFTLTISSLQPEDFATYYCQQSYSTPLLTFGGGTKVEIK

SEQ ID NO: 765 - protein, 121 aa, Artificial Sequence
  Description of Artificial Sequence: Synthetic heavy chain variable region amino acid sequence
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKDNWNYDAFDIWGQGTMVTVSS

SEQ ID NO: 766 - protein, 110 aa, Artificial Sequence
  Description of Artificial Sequence: Synthetic light chain variable region amino acid sequence
SYELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVL

SEQ ID NO: 767 - protein, 122 aa, Artificial Sequence
  Description of Artificial Sequence: Synthetic heavy chain variable region amino acid sequence
QVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDSGLGSRGDAFDIWGQGTMVTVSS

SEQ ID NO: 768 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVL

SEQ ID NO: 769 - protein, 122 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCAREGDYYGSGRPFDYWGQGTLVTVSS

SEQ ID NO: 770 - protein, 110 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVVFGGGTKLTVL

SEQ ID NO: 771 - protein, 121 aa, Artificial Sequence
  Description of Artificial Sequence: Synthetic heavy chain variable region amino acid sequence
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCAISLYGDYRTDAFDIWGQGTTVTVSS

SEQ ID NO: 772 - protein, 106 aa, Artificial Sequence
  Description of Artificial Sequence: Synthetic light chain variable region amino acid sequence
EIVLTQSPSSFSASTGDRVTITCRASQGISSYLAWYQQKPGKAPKLLIYAASTLQSGVPSRFSGSGSGTDFTLTISCLQSEDFATYYCQQYYSYPLFGGGTKVEIK

SEQ ID NO: 773 - protein, 120 aa, Artificial Sequence
  Description of Artificial Sequence: Synthetic heavy chain variable region amino acid sequence
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCSSVGGYYYYGMDVWGQGTTVTVSS

SEQ ID NO: 774 - protein, 112 aa, Artificial Sequence
  Description of Artificial Sequence: Synthetic light chain variable region amino acid sequence
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLYTFGQGTKVEIK

SEQ ID NO: 775 - protein, 120 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRGYGSGALDYWGQGTLVTVSS

SEQ ID NO: 776 - protein, 110 aa, Artificial Sequence
  Description of Artificial Sequence: Synthetic light chain variable region amino acid sequence
QPVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVL

SEQ ID NO: 777 - protein, 122 aa, Artificial Sequence
  Description of Artificial Sequence: Synthetic heavy chain variable region amino acid sequence
EVQLVESGGGLVQPGGSLRLSCAASGFTVSSNYMSWVRQAPGKGLEWVSVIYSDGSTYYADSVKGRFTISRHNSKNTLYLQMNSLRAEDTAVYYCARCSTYGDYIDWYFDLWGRGTLVTVSS

SEQ ID NO: 778 - protein, 107 aa, Artificial Sequence
  Description of Artificial Sequence: Synthetic light chain variable region amino acid sequence
ETTLTQSPATLSVSPGERATLSCRASQSVSSNLAWYQQKPGQAPRLLIYGASTRATGIPARFSGSGSGTEFTLTISSLQSEDFAVYYCQQYNNWPLSFGGGTKLEIK

SEQ ID NO: 779 - protein, 121 aa, Artificial Sequence
  Description of Artificial Sequence: Synthetic heavy chain variable region amino acid sequence
EVQLVESGGGLVKPGGSLRLACAASGFSFRSYRMNWVRQAPGKGLEWVSSISSSSSYIDYADSVKGRFTISRDNAKNTVYLQVNSLRAEDTAVYYCARDGRTIFGVVIDYWGQGTLVTVSS

SEQ ID NO: 780 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNNNRPSGVPDRFSGSKSGTSASLVITGLQAEDEADYYCQSYDSSLSVVFGGGTKLTVL

SEQ ID NO: 781 - protein, 124 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARGFHYYGSGSHDAFDIWGQGTMVTVSS

SEQ ID NO: 782 - protein, 110 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVFGGGTKLTVL

SEQ ID NO: 783 - protein, 121 aa, Artificial Sequence
  Description of Artificial Sequence: Synthetic heavy chain variable region amino acid sequence
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGGSMVRGLGFDPWGQGTLVTVSS

SEQ ID NO: 784 - protein, 112 aa, Artificial Sequence
  Description of Artificial Sequence: Synthetic light chain variable region amino acid sequence
DIQLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKLEIK

SEQ ID NO: 785 - protein, 122 aa, Artificial Sequence
  Description of Artificial Sequence: Synthetic heavy chain variable region amino acid sequence
QVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVPSDFWSGYYNDYWGQGTLVTVSS

SEQ ID NO: 786 - protein, 112 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSWVFGGGTKLTVL

SEQ ID NO: 787 - protein, 123 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISASSSYIFYSDLVKGRFTISRDNAKNSLYLQMNSLRAEDTAVYYCARAGYYYGSGSYYVDYWGQGTLVTVSS

SEQ ID NO: 788 - protein, 111 aa, Artificial Sequence
  Description of Artificial Sequence: Synthetic light chain variable region amino acid sequence
QSVLTQPPSVSGAPGQRVAISCTGSSSNIGAGYDVHWYQQLPGTAPKLLIYGNSNRPSGVPDRFSGSKSGTSASLAITGLQAEDEADYYCQSYGSSLSGWVFGGGTKLTVL

SEQ ID NO: 789 - protein, 124 aa, Artificial Sequence
  Description of Artificial Sequence: Synthetic heavy chain variable region amino acid sequence
QVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARALTYYYDSSGHGADYWGQGTLVTVSS

SEQ ID NO: 790 - protein, 110 aa, Artificial Sequence; identical to SEQ ID NO: 770
  Description of Artificial Sequence: Synthetic light chain variable region amino acid sequence

SEQ ID NO: 791 - protein, 124 aa, Artificial Sequence
  Description of Artificial Sequence: Synthetic heavy chain variable region amino acid sequence
QVQLVQSGGGLVQPGGSLRLSCAASGFTFSSYAMSWVRQAPGKGLEWVSTISGSGGSTYYADSVKGRFTISRDNSKNTLYLQMNSLRAEDTAVYYCATWKRWGSGYYYSYMDVWGKGTTVTVSS

SEQ ID NO: 792 - protein, 107 aa, Artificial Sequence
  Description of Artificial Sequence: Synthetic light chain variable region amino acid sequence
DIQLTQSPSTLSASVGDRVTITCRASQSISSWLAWYQQKPGKAPKLLIYDAFSLESGVPSRFSGSGSGTEFTLTISSLQPDDFATYYCQQYNSYSVTFGGGTKVEIK

SEQ ID NO: 793 - protein, 120 aa, Artificial Sequence
  Description of Artificial Sequence: Synthetic heavy chain variable region amino acid sequence
EVQLVESGGGLVKPGGSLRLSCAASGFPFSTSSMNWVRQAPGKGLEWVSSISSSSSYIDYADSVKGRFTISRDNAKNSLYLQMNSLRAGDTAVYYCARVPRSDWYYFDYWGQGTLVTVSS

SEQ ID NO: 794 - protein, 111 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKFLIYDNKYRPSGVPDRFSGSKSGTSASLAITGLQAEDEADYYCQSYDSSLSGYVFGTGTKLTVL

SEQ ID NO: 795 - protein, 123 aa, Artificial Sequence
  Description of Artificial Sequence: Synthetic heavy chain variable region amino acid sequence
EVQLLESGGGLVQPGRSLRLSCAASGFTFDDYAMHWVRQAPGKGLEWVSGISWNSGSIGYADSVKGRFTISRDNAKNSLYLQMNSLRAEDTALYYCAKDLRGGTYYYYGMDVWGQGTTVTVSS

SEQ ID NO: 796 - protein, 107 aa, Artificial Sequence
  Description of Artificial Sequence: Synthetic light chain variable region amino acid sequence
DIRVTQSPSSLSASVGDRVTITCRASQSISSYLNWYQQKPGKAPKLLIYAASSLQSGVPSRFSGSGSGTDFTLTISSLQPEDFATYYCQQSYSTPPTFGGGTKVEIK

SEQ ID NO: 797 - protein, 127 aa, Artificial Sequence
  Description of Artificial Sequence: Synthetic heavy chain variable region amino acid sequence
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARAIYYYDSSGYYYVGDAFDIWGQGTTVTVSS

SEQ ID NO: 798 - protein, 110 aa, Artificial Sequence
  Description of Artificial Sequence: Synthetic light chain variable region amino acid sequence
QSVLTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGVFGGGTKLTVL

SEQ ID NO: 799 - protein, 127 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARQGVGTVTTWNYYYYYMDVWGKGTTVTVSS

SEQ ID NO: 800 - protein, 110 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSWVFGGGTKLTVL

SEQ ID NO: 801 - protein, 122 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVLVATAYGNAFDIWGQGTMVTVSS

SEQ ID NO: 802 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLTVVFGGGTKLTVL

SEQ ID NO: 803 - protein, 121 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARDQVYSYGYYFDYWGQGTLVTVSS

SEQ ID NO: 804 - protein, 113 aa, Artificial Sequence
  Description of Artificial Sequence: Synthetic light chain variable region amino acid sequence
QSVLAQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSHVVFGGGTKLTVL

SEQ ID NO: 805 - protein, 129 aa, Artificial Sequence
  Description of Artificial Sequence: Synthetic heavy chain variable region amino acid sequence
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDGFPTNYDFWSGYSDDAFDIWGQGTMVTVSS

SEQ ID NO: 806 - protein, 108 aa, Artificial Sequence
  Description of Artificial Sequence: Synthetic light chain variable region amino acid sequence
DIVMTQSPATLSVSPGERATLSCRASQSVSSNLAWYQQKPGQAPRLLIYGASTRATGIPARFSGSGSGTEFTLTISSLQSEDFAVYYCQQYNNWPPLTFGQGTKVDIK

SEQ ID NO: 807 - protein, 122 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVPPHDYGGYYFDYWGQGTLVTVSS

SEQ ID NO: 808 - protein, 110 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYRNSNRPSGVPDRFSGSKSGTSASLAIIGLQAEDEADYYCQSYDSSLSVVFGGGTKLTVL

SEQ ID NO: 809 - protein, 119 aa, Artificial Sequence
  Description of Artificial Sequence: Synthetic heavy chain variable region amino acid sequence
EVQLVESGPGLVKPSQTLSLTCTVSGGSISSGDYYWSWIRQPPGKGLEWIGYIYYSGSTYYNPSLKSRVTISVDTSKNQFSLKLSSVTAADTAVYYCARESIVGAVDYWGQGTLVTVSS

SEQ ID NO: 810 - protein, 113 aa, Artificial Sequence
  Description of Artificial Sequence: Synthetic light chain variable region amino acid sequence
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPHTFGQGTKLEIK

SEQ ID NO: 811 - protein, 124 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDYCSGGSCYLAAFDIWGQGTTVTVSS

SEQ ID NO: 812 - protein, 111 aa, Artificial Sequence
  Description of Artificial Sequence: Synthetic light chain variable region amino acid sequence
QPVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPVVFGGGTKLTVL

SEQ ID NO: 813 - protein, 118 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARDDGILWLDYWGQGTLVTVSS

SEQ ID NO: 814 - protein, 110 aa, Artificial Sequence
  Description of Artificial Sequence: Synthetic light chain variable region amino acid sequence
QPGLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGQVFGGGTKLTVL

SEQ ID NO: 815 - protein, 119 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSNYIYYADSVKGRFTISRDNAKNSLYLQMNSLRAEDTAVYYCARDRIAAYTFDYWGQGTLVTVSS

SEQ ID NO: 816 - protein, 110 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLPYVFGTGTKVTVL

SEQ ID NO: 817 - protein, 120 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDTVVAGIYFDYWGQGTLVTVSS

SEQ ID NO: 818 - protein, 111 aa, Artificial Sequence; identical to SEQ ID NO: 272
  Description of Artificial Sequence: Synthetic light chain variable region amino acid sequence

SEQ ID NO: 819 - protein, 128 aa, Artificial Sequence
  Description of Artificial Sequence: Synthetic heavy chain variable region amino acid sequence
QVQLVQSGGVVVQPGGSLRLSCAASGFTFDDYTMHWVRQAPGKGLEWVSLIGWDGGSTYYADSVKGRFTISRDNSKYSLYLQMNSLRTEDTALYYCAKDLGSSSGYFLGRDYYGMDVWGQGTTVTVSS

SEQ ID NO: 820 - protein, 106 aa, Artificial Sequence
  Description of Artificial Sequence: Synthetic light chain variable region amino acid sequence
DIQLTQSPSSLSASVGDRVTITCQASQDISNYLNWYQQKPGKAPKLLIYDASNLETGVPSRFSGSGSGTDFTFTISSLQPEDIATYYCQQYNNLPTFGGGTKLEIK

SEQ ID NO: 821 - protein, 122 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCAREDYGDYYYYYMDVWGKGTTVTVSS

SEQ ID NO: 822 - protein, 111 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVFGTGTKVTVL

SEQ ID NO: 823 - protein, 117 aa, Artificial Sequence
  Description of Artificial Sequence: Synthetic heavy chain variable region amino acid sequence
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARAYELELDYWGQGTLVTVSS

SEQ ID NO: 824 - protein, 110 aa, Artificial Sequence
  Description of Artificial Sequence: Synthetic light chain variable region amino acid sequence
QSVLIQPPSASGSPGQSVTISCTGTSSDVGGYNYVSWYQQHPGKAPKLMIYEVSKRPSGVPDRFSGSKSGNTASLTVSGLQAEDEADYYCSSYAGSNNVVFGGGTKLTVL

SEQ ID NO: 825 - protein, 117 aa, Artificial Sequence
  Description of Artificial Sequence: Synthetic heavy chain variable region amino acid sequence
QVQLVESGAEVKKPGASVKVSCKASGYTFTSYAIHWVRQAPGQRLEWMGWINAGNGNTKYSQKFQGRVTITRDTSASTAYMELSSLRSEDTAVYYCASEESGYFDYWGQGTLVTVSS

SEQ ID NO: 826 - protein, 106 aa, Artificial Sequence
  Description of Artificial Sequence: Synthetic light chain variable region amino acid sequence
SYELMQPPSVPVSPGQTASITCSGDKLGDKYACWYQQKPGQSPVLVIYQDRKRPSGIPERFSGSNSGNTATLTISGTQAMDEADYYCQAWDSSTVVFGGGTKVTVL

SEQ ID NO: 827 - protein, 121 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDRRFGELFYFDYWGQGTLVTVSS

SEQ ID NO: 828 - protein, 112 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGNWVFGGGTKLTVL

SEQ ID NO: 829 - protein, 123 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARRYCTNGVCYDAFDIWGQGTMVTVSS

SEQ ID NO: 830 - protein, 110 aa, Artificial Sequence; identical to SEQ ID NO: 692
  Description of Artificial Sequence: Synthetic light chain variable region amino acid sequence

SEQ ID NO: 831 - protein, 124 aa, Artificial Sequence
  Description of Artificial Sequence: Synthetic heavy chain variable region amino acid sequence
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARAGIVVVPKYYYYMDVWGKGTTVTVSS

SEQ ID NO: 832 - protein, 109 aa, Artificial Sequence
  Description of Artificial Sequence: Synthetic light chain variable region amino acid sequence
DIVMTQSPGTLSLSPGERATLSCRASQSVSSSYLAWYQQKPGQAPRLLIYGASSRATGIPDRFSGSGSGTDFTLTISRLEPEDFAVYYCQQYGSSPMYTFGQGTKVEIK

SEQ ID NO: 833 - protein, 122 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCAREGYYYGSGSYLDYWGQGTLVTVSS

SEQ ID NO: 834 - protein, 110 aa, Artificial Sequence; identical to SEQ ID NO: 770
  Description of Artificial Sequence: Synthetic light chain variable region amino acid sequence

SEQ ID NO: 835 - protein, 120 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARGGYSYGYSFDYWGQGTLVTVSS

SEQ ID NO: 836 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVVFGGGTKLTVL

SEQ ID NO: 837 - protein, 124 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARDGSPINWVSPFPFDYWGQGTLVTVSS

SEQ ID NO: 838 - protein, 111 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTQLTVL

SEQ ID NO: 839 - protein, 123 aa, Artificial Sequence
  Description of Artificial Sequence: Synthetic heavy chain variable region amino acid sequence
EVQLLESGGGLVKPGGSLRLSCAASGLTFSDYYMSWIRQAPGKGLEWVSYISGGSSYSNYADSVKGRFTISRDNAKNSLYLQMNSLRAEDTAVYYCARGYCSGSSCYEAFDIWGQGTTVTVSS

SEQ ID NO: 840 - protein, 111 aa, Artificial Sequence
  Description of Artificial Sequence: Synthetic light chain variable region amino acid sequence
SYVLTQPPSVSGAPGQRVTISCTGSSSNIGAGFDVHWYQQLPGTAPKLLIYGNSDRPSGVPDRFSGSKSGTSASLAITGLQAEDEADYYCQSYDSSLSGYVFGTGTKVTVL

SEQ ID NO: 841 - protein, 124 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISGGSSYIYYADSVKGRFTISRDNAKNSLYLQMNSLRAEDTAVYYCAREAYYYDSSGLKWFDPWGQGTLVTVSS

SEQ ID NO: 842 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLGWVFGGGTKLTVL

SEQ ID NO: 843 - protein, 127 aa, Artificial Sequence
  Description of Artificial Sequence: Synthetic heavy chain variable region amino acid sequence
EVQLLESGPGLVKPSQTLSLTCTVSGGSISSGGYYWSWIRQHPGKGLEWIGYIYYSGSTYYNPSLKSRVTISVDTSKNQFSLKLSSVTAADTAVYYCARLEIGDGSGSYLHWYFDLWGRGTLVTVSS

SEQ ID NO: 844 - protein, 106 aa, Artificial Sequence
  Description of Artificial Sequence: Synthetic light chain variable region amino acid sequence
SYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVL

SEQ ID NO: 845 - protein, 121 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSRSYIYYADSVKGRFTISRDNAKNSLYLQMNSLRAEDTAVYYCARVGSGGSGTYGDYWGQGTLVTVSS

SEQ ID NO: 846 - protein, 111 aa, Artificial Sequence; identical to SEQ ID NO: 288
  Description of Artificial Sequence: Synthetic light chain variable region amino acid sequence

SEQ ID NO: 847 - protein, 120 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRHNAKNSLYLQMNSLRAEDTAVYYCARGSSSSWFCFDYWGQGTLVTVSS

SEQ ID NO: 848 - protein, 110 aa, Artificial Sequence
  Description of Artificial Sequence: Synthetic light chain variable region amino acid sequence
SYVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSYVFGTGTKLTVL

SEQ ID NO: 849 - protein, 125 aa, Artificial Sequence
  Description of Artificial Sequence: Synthetic heavy chain variable region amino acid sequence
GVQLVESGPGLVKPSETLSLTCTVSGGSISSYYWSWIRQPPGKGLEWIGYIYYSGSTNYNPSLKSRVTISVDTSKNQFSLKLSSVTAADTAVYYCARGYYYDSSGYYPNDAFDIWGQGTMVTVSS

SEQ ID NO: 850 - protein, 107 aa, Artificial Sequence
  Description of Artificial Sequence: Synthetic light chain variable region amino acid sequence
DIQVTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 851 - protein, 131 aa, Artificial Sequence
  Description of Artificial Sequence: Synthetic heavy chain variable region amino acid sequence
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARHVGQVYCSSTSCYTSREYYFDYWGQGTLVTVSS

SEQ ID NO: 852 - protein, 107 aa, Artificial Sequence
  Description of Artificial Sequence: Synthetic light chain variable region amino acid sequence
SYVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVL

SEQ ID NO: 853 - protein, 120 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDDSSSWYYFDYWGQGTLVTVSS

SEQ ID NO: 854 - protein, 111 aa, Artificial Sequence; identical to SEQ ID NO: 768
  Description of Artificial Sequence: Synthetic light chain variable region amino acid sequence

SEQ ID NO: 855 - protein, 121 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARLDYSNYYYYMDVWGKGTTVTVSS

SEQ ID NO: 856 - protein, 111 aa, Artificial Sequence; identical to SEQ ID NO: 342
  Description of Artificial Sequence: Synthetic light chain variable region amino acid sequence

SEQ ID NO: 857 - protein, 124 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGGYSYGAYYYYYMDVWGKGTTVTVSS

SEQ ID NO: 858 - protein, 112 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYWVFGGGTKLTVL

SEQ ID NO: 859 - protein, 124 aa, Artificial Sequence; identical to SEQ ID NO: 857
  Description of Artificial Sequence: Synthetic heavy chain variable region amino acid sequence

SEQ ID NO: 860 - protein, 112 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYWVFGGGTKVTVL

SEQ ID NO: 861 - protein, 122 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARSIAVAGTGYGMDVWGQGTTVTVSS

SEQ ID NO: 862 - protein, 110 aa, Artificial Sequence; identical to SEQ ID NO: 836
  Description of Artificial Sequence: Synthetic light chain variable region amino acid sequence

SEQ ID NO: 863 - protein, 125 aa, Artificial Sequence
  Description of Artificial Sequence: Synthetic heavy chain variable region amino acid sequence
EVQLLESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREVVPAAIRAGYYFDYWGQGTLVTVSS

SEQ ID NO: 864 - protein, 107 aa, Artificial Sequence
  Description of Artificial Sequence: Synthetic light chain variable region amino acid sequence
SYELMQPPSVSVSPGQTASITCSGDKLGDKYACWYQQKPGQSPVLVIYQDSKRPSGIPERFSGSNSGNTATLTISGTQAMDEADYYCQAWDSSTGGVFGTGTQLTVL

SEQ ID NO: 865 - protein, 124 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARGYCTNGVCYLDAFDIWGQGTTVTVSS

SEQ ID NO: 866 - protein, 111 aa, Artificial Sequence
  Description of Artificial Sequence: Synthetic light chain variable region amino acid sequence
QSVLIQPASVSGSPGQSITISCTGTSSDVGGYNYVSWYQQHPGKAPKLMIYDVSNRPSGVSNRFSGSKSGNTASLTISGLQAEDEADYYCSSYTSSSTPVVFGGGTKVTVL

SEQ ID NO: 867 - protein, 119 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVASEVWFFDLWGRGTLVTVSS

SEQ ID NO: 868 - protein, 111 aa, Artificial Sequence; identical to SEQ ID NO: 342
  Description of Artificial Sequence: Synthetic light chain variable region amino acid sequence

SEQ ID NO: 869 - protein, 124 aa, Artificial Sequence
  Description of Artificial Sequence: Synthetic heavy chain variable region amino acid sequence
EVQLLESGGGLVQPGGSLRLSCAASGFTFSSYWMSWVRQAPGKGLEWVANIKQDGSEKYYVDSVKGRFTISRDNAKNSLYLQMNSLRAEDTAVYYCARDGLLQYDFWSGYYDYWGQGTLVTVSS

SEQ ID NO: 870 - protein, 107 aa, Artificial Sequence
  Description of Artificial Sequence: Synthetic light chain variable region amino acid sequence
EIVLTQSPSSLSASVGDRVTITCRASQGISSWLAWYQQKPEKAPKSLIYAASSLQSGVPSRFSGSGSGTDFTLTISSLQPEDFATYYCQQYNSYPFTFGPGTKVDIK

SEQ ID NO: 871 - protein, 123 aa, Artificial Sequence
  Description of Artificial Sequence: Synthetic heavy chain variable region amino acid sequence
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDHWSNPLYYYGMDVWGQGTTVTVSS

SEQ ID NO: 872 - protein, 107 aa, Artificial Sequence
  Description of Artificial Sequence: Synthetic light chain variable region amino acid sequence
SYELTQPPSVSVSPGQTARITCSGDVLAKKYARWFQQKPGQAPVLVIYKDSERPSGIPERFSGSSSGTTVTLTISGAQVEDEADYYCYSAADNNLGVFGGGTQLTVL

SEQ ID NO: 873 - protein, 124 aa, Artificial Sequence
  Description of Artificial Sequence: Synthetic heavy chain variable region amino acid sequence
EVQLLESGAEVKKPGSSVKVSCKASGGTFSSYAISWVRQAPGQGLEWMGGIIPIFGTANYAQKFQGRVTITADESTSTAYMELSSLRSEDTAVYYCARSRYSGSYYYYYGMDVWGQGTTVTVSS

SEQ ID NO: 874 - protein, 106 aa, Artificial Sequence
  Description of Artificial Sequence: Synthetic light chain variable region amino acid sequence
QPVLTQPPSVSVSPGQTASITCSGDKLGDKYACWYQQKPGQSPVLVIYQDSKRPSGIPERFSGSNSGNTATLTISGTQAMDEADYYCQAWDSSTYVFGTGTKLTVL

SEQ ID NO: 875 - protein, 120 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVVGYSGSYLDYWGQGTLVTVSS

SEQ ID NO: 876 - protein, 111 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVL

SEQ ID NO: 877 - protein, 124 aa, Artificial Sequence
  Description of Artificial Sequence: Synthetic heavy chain variable region amino acid sequence
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARSRYSGSYYYYYGMDVWGQGTTVTVSS

SEQ ID NO: 878 - protein, 106 aa, Artificial Sequence
  Description of Artificial Sequence: Synthetic light chain variable region amino acid sequence
SYELTQPPSVSVSPGQTASITCSGDKLGDKYACWYQQKPGQSPVLVIYQDSKRPSGIPERFSGSNSGNTATLTISGTQAMDEADYYCQAWDSSTYVFGTGTKLTVL

SEQ ID NO: 879 - protein, 118 aa, Artificial Sequence
  Description of Artificial Sequence: Synthetic heavy chain variable region amino acid sequence
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDWAWDAFDIWGQGTMVTVSS

SEQ ID NO: 880 - protein, 110 aa, Artificial Sequence
  Description of Artificial Sequence: Synthetic light chain variable region amino acid sequence
QPGLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVFGGGTKLTVL

SEQ ID NO: 881 - protein, 118 aa, Artificial Sequence
  Description of Artificial Sequence: Synthetic heavy chain variable region amino acid sequence
EVQLVESGAEVKKPGASVKVSCKASGYTFTGYYMHWVRQAPGQGLEWMGWINPNSGGTNYAQKFQGRVTMTRDTSISTAYMELSRLRSDDTAVYYCARDWAWDAFDIWGQGTMVTVSS

SEQ ID NO: 882 - protein, 110 aa, Artificial Sequence
  Description of Artificial Sequence: Synthetic light chain variable region amino acid sequence
QSVLIQPASVSGSPGQSITISCTGTSSDVGGYNYVSWYQQHPGKAPKLMIYDVSNRPSGVSNRFSGSKSGNTASLTISGLQAEDEADYYCSSYTSSSTLVFGGGTQLTVL

SEQ ID NO: 883 - protein, 123 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCAREWSPIVVVTNAFDIWGQGTMVTVSS

SEQ ID NO: 884 - protein, 111 aa, Artificial Sequence; identical to SEQ ID NO: 324
  Description of Artificial Sequence: Synthetic light chain variable region amino acid sequence

SEQ ID NO: 885 - protein, 120 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARGSSSSWYYFDYWGQGTLVTVSS

SEQ ID NO: 886 - protein, 110 aa, Artificial Sequence; identical to SEQ ID NO: 692
  Description of Artificial Sequence: Synthetic light chain variable region amino acid sequence

SEQ ID NO: 887 - protein, 118 aa, Artificial Sequence
  Description of Artificial Sequence: Synthetic heavy chain variable region amino acid sequence
QVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCARDANWGAFDIWGQGTMVTVSS

SEQ ID NO: 888 - protein, 110 aa, Artificial Sequence
  Description of Artificial Sequence: Synthetic light chain variable region amino acid sequence
QSVLIQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 889 - protein, 125 aa, Artificial Sequence
  Description of Artificial Sequence: Synthetic heavy chain variable region amino acid sequence
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKDYYYDSSGYPPYGIGVWGQGTTVTVSS

SEQ ID NO: 890 - protein, 110 aa, Artificial Sequence
  Description of Artificial Sequence: Synthetic light chain variable region amino acid sequence
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGIWVFGGGTKVTVL

SEQ ID NO: 891 - protein, 117 aa, Artificial Sequence
  Description of Artificial Sequence: Synthetic heavy chain variable region amino acid sequence
EVQLLESGGGLIQPGGSLRLSCAASGFTVSSNYMSWVRQAPGKGLEWVSVIYSGGSTYYADSVKGRFTISRDNSKNTLYLQMNSLRAEDTAVYYCARGGIADAFDIWGQGTMVTVSS

SEQ ID NO: 892 - protein, 107 aa, Artificial Sequence
  Description of Artificial Sequence: Synthetic light chain variable region amino acid sequence
ETTLTQSPSSVSASVGDRVTITCRASQGISSWLAWYQQKPGKAPKLLIYAASSLQSGVPSRFSGSGSGTDFTLTISSLQPEDFATYYCQQANSFPRTFGQGTKLEIK

SEQ ID NO: 893 - protein, 125 aa, Artificial Sequence
  Description of Artificial Sequence: Synthetic heavy chain variable region amino acid sequence
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGPQFGVSYSSGWYSFDYWGQGTLVTVSS

SEQ ID NO: 894 - protein, 111 aa, Artificial Sequence
  Description of Artificial Sequence: Synthetic light chain variable region amino acid sequence
QSVLIQPRSVSGSPGQSVTISCTGTSSDVGGYNYVSWYQQHPGKAPKLMIYDVSKRPSGVPDRFSGSKSGNTASLTISGLQAEDEADYYCCSYAGSYTFVVFGGGTKLTVL

SEQ ID NO: 895 - protein, 124 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVSSGWYGGGAYYFDYWGQGTLVTVSS

SEQ ID NO: 896 - protein, 112 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALYVFGTGTKVTVL

SEQ ID NO: 897 - protein, 123 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARQRGGIAVAGTYFDLWGRGTLVTVSS

SEQ ID NO: 898 - protein, 108 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSTVVFGGGTKLTVL

SEQ ID NO: 899 - protein, 123 aa, Artificial Sequence; identical to SEQ ID NO: 897
  Description of Artificial Sequence: Synthetic heavy chain variable region amino acid sequence

SEQ ID NO: 900 - protein, 108 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSTVVFGGGTKVTVL

SEQ ID NO: 901 - protein, 122 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARGYGSGSYLDYFDYWGQGTLVTVSS

SEQ ID NO: 902 - protein, 112 aa, Artificial Sequence
  Description of Artificial Sequence: Synthetic light chain variable region amino acid sequence
QPGLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGFYVFGTGTKLTVL

SEQ ID NO: 903 - protein, 119 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARDAAAKYYFDYWGQGTLVTVSS

SEQ ID NO: 904 - protein, 111 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGKVFGTGTKLTVL

SEQ ID NO: 905 - protein, 122 aa, Artificial Sequence
  Description of Artificial Sequence: Synthetic heavy chain variable region amino acid sequence
QVQLVESGGGLVKPGGSLRLSCAASGFTFSDYYMSWIRQAPGKGLEWVSYISSSSSYTNYADSVKGRFTISRDNAKNSLYLQMNSLRAEDTAVYYCARVGYSSSWYNYFDYWGQGTLVTVSS

SEQ ID NO: 906 - protein, 111 aa, Artificial Sequence
  Description of Artificial Sequence: Synthetic light chain variable region amino acid sequence
SYVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGPVFGGGTKLTVL

SEQ ID NO: 907 - protein, 123 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARIRFDYGSGSYAFDIWGQGTMVTVSS

SEQ ID NO: 908 - protein, 111 aa, Artificial Sequence; identical to SEQ ID NO: 700
  Description of Artificial Sequence: Synthetic light chain variable region amino acid sequence

SEQ ID NO: 909 - protein, 123 aa, Artificial Sequence
  Description of Artificial Sequence: Synthetic heavy chain variable region amino acid sequence
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGLPRFGVVTPNWFDPWGQGTLVTVSS

SEQ ID NO: 910 - protein, 113 aa, Artificial Sequence
  Description of Artificial Sequence: Synthetic light chain variable region amino acid sequence
EIVLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 911 - protein, 123 aa, Artificial Sequence
  Description of Artificial Sequence: Synthetic heavy chain variable region amino acid sequence
EVQLLESGGGLVQPGGSLRLSCAASGFTFSSYWMHWVRQAPGKGLVWVSRINSDGSSTSYADSVKGRFTISRDNAKNTLYLQMNSLRAEDTAVYYCAREGDSSGWPGGAFDIWGQGTMVTVSS

SEQ ID NO: 912 - protein, 108 aa, Artificial Sequence
  Description of Artificial Sequence: Synthetic light chain variable region amino acid sequence
SYVLTQPPSVSVSPGQAARITCSGDALPKQYAYWYQQKPGQAPVLVIYKDSERPSGIPERFSGSSSGTTVTLTISGVQAEDEADYYCQSADSSGTFYVFGTGTKLTVL

SEQ ID NO: 913 - protein, 124 aa, Artificial Sequence
  Description of Artificial Sequence: Synthetic heavy chain variable region amino acid sequence
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDPYSSSSYYYYGMDVWGQGTTVTVSS

SEQ ID NO: 914 - protein, 112 aa, Artificial Sequence
  Description of Artificial Sequence: Synthetic light chain variable region amino acid sequence
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLYTFGQGTKVDIK

SEQ ID NO: 915 - protein, 120 aa, Artificial Sequence
  Description of Artificial Sequence: Synthetic heavy chain variable region amino acid sequence
EVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCARGPYDSSGYCDYWGQGTLVTVSS

SEQ ID NO: 916 - protein, 107 aa, Artificial Sequence
  Description of Artificial Sequence: Synthetic light chain variable region amino acid sequence
SYELMQPPSVSVAPGKTARITCGGNNIGSKSVHWYQQKPGQAPVLVVYDDSDRPSGTPERFSGSNSGNTATLTISRVEAGDEADYYCQVWDSSSDQVFGGGTKVTVL

SEQ ID NO: 917 - protein, 120 aa, Artificial Sequence; identical to SEQ ID NO: 915
  Description of Artificial Sequence: Synthetic heavy chain variable region amino acid sequence

SEQ ID NO: 918 - protein, 107 aa, Artificial Sequence
  Description of Artificial Sequence: Synthetic light chain variable region amino acid sequence
SYELTQPPSVSVAPGKTARITCGGNNIGSKSVHWYQQKPGQAPVLVVYDDSDRPSGIPERFSGSNSGNTATLTISRVEAGDEADYYCQVWDSSSDQVFGGGTKLTVL

SEQ ID NO: 919 - protein, 118 aa, Artificial Sequence
  Description of Artificial Sequence: Synthetic heavy chain variable region amino acid sequence
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARGLYNWNHDYWGQGTLVTVSS

SEQ ID NO: 920 - protein, 110 aa, Artificial Sequence
  Description of Artificial Sequence: Synthetic light chain variable region amino acid sequence
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSNVVFGGGTKVTVL

SEQ ID NO: 921 - protein, 119 aa, Artificial Sequence
  Description of Artificial Sequence: Synthetic heavy chain variable region amino acid sequence
QVTLKESGGGLVKPGGSLRLSCAASGFTFSSYSMNWVRQAPGKGLEWVSSISSSSSYIYYADSVKGRFTISRDNAKNSLYLQMNSLRAEDTAVYYCARYSSSLGAFDIWGQGTMVTVSS

SEQ ID NO: 922 - protein, 110 aa, Artificial Sequence
  Description of Artificial Sequence: Synthetic light chain variable region amino acid sequence
QSALTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSDVFGTGTKLTVL

SEQ ID NO: 923 - protein, 119 aa, Artificial Sequence
  Description of Artificial Sequence: Synthetic heavy chain variable region amino acid sequence
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDSTYSEAFDIWGQGTMVTVSS

SEQ ID NO: 924 - protein, 110 aa, Artificial Sequence
  Description of Artificial Sequence: Synthetic light chain variable region amino acid sequence
QSVLIQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKVTVL

SEQ ID NO: 925 - protein, 119 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARYSSSLGAFDIWGQGTTVTVSS

SEQ ID NO: 926 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSDVFGTGTKVTVL

SEQ ID NO: 927 - protein, 120 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARYQSSSWYYFDYWGQGTLVTVSS

SEQ ID NO: 928 - protein, 111 aa, Artificial Sequence
  Description of Artificial Sequence: Synthetic light chain variable region amino acid sequence
SYVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVL

SEQ ID NO: 929 - protein, 119 aa, Artificial Sequence
  Description of Artificial Sequence: Synthetic heavy chain variable region amino acid sequence
QVQLQESGPGLVKPSETLSLTCTVSPPSISSSSYYWGWIRQPPGKGLEWIGSIYYSGSTYYNPSLKSRVTISVDTSKNQFSLKLSSVTAADTAVYYCARPDSSGAFDIWGQGTMVTVSS

SEQ ID NO: 930 - protein, 108 aa, Artificial Sequence
  Description of Artificial Sequence: Synthetic light chain variable region amino acid sequence
SYELTQPPSVSVSPGQTARITCSADALPKQYAYWYQQKPGQAPVLVIYKDSERPSGIPERFSGSSSGTTVTLTISGVQAEDEADYYCQSADSSGTYVVFGGGTKLTVL

SEQ ID NO: 931 - protein, 123 aa, Artificial Sequence
  Description of Artificial Sequence: Synthetic heavy chain variable region amino acid sequence
EVQLVQSGAEVKKPGASVRVYCKASGYTFTTYYIHWVRQAPGQGLEWMGMINPSGGTTSYAQKFQGRLTMTGDTSTSTVYMELNYLRSEDTAVYYCTRDFIYFYGSGDGFDYWGQGTLVTVSS

SEQ ID NO: 932 - protein, 107 aa, Artificial Sequence
  Description of Artificial Sequence: Synthetic light chain variable region amino acid sequence
EIVMTQSPSAMSASVGDRVTITCRASQGISNYLAWFQQKPGKVPKRLIYAASSLQSGVPSRFSGSGSGTEFTLTITSLQPEDFATYYCLQHNSYPFTFGPGTKVEIK

SEQ ID NO: 933 - protein, 125 aa, Artificial Sequence
  Description of Artificial Sequence: Synthetic heavy chain variable region amino acid sequence
QVQLVQSGAEVKKPGSSVKVSCKASGGTFSTYTINWVRQAPGQGLEWMGRITPSLGVPLSAQKFQGRITISADKSTTTAYMELSSLGSEDTAVYYCASLNYYDTTDYYLGYSDSWGQGTLVTVSS

SEQ ID NO: 934 - protein, 109 aa, Artificial Sequence
  Description of Artificial Sequence: Synthetic light chain variable region amino acid sequence
DIVLTQTPATLSVSPGERATLSCRASHSVSNNLAWYQQKPGQAPRLLIYSASTRATGIPARFSGRGSGTEFTLTISSLQPEDFAVYYCQQYNNWPPEYTFGQGTKVDIK

SEQ ID NO: 935 - protein, 119 aa, Artificial Sequence
  Description of Artificial Sequence: Synthetic heavy chain variable region amino acid sequence
EVQLLESGGGLVKPGGSLRLSCAASGFTFSGYYMTWIRQAPEKGLEWVSYISGGSTYTNYADSVRGRFTISRDNARNSLYLQMNSLRAEDTAVYYCARDGGYGIGPLYWGQGSLVTVSS

SEQ ID NO: 936 - protein, 111 aa, Artificial Sequence
  Description of Artificial Sequence: Synthetic light chain variable region amino acid sequence
QPVLTQPPSVSGAPGQRVTISCTGSSSNIGAPFDVHWYQQLPGTAPKPLIYGNSNRPSGVPDRFSGSKSGTSASLAITGLQAEDEADYYCQSYDSSLGGYVFGTGTKLTVL

SEQ ID NO: 937 - protein, 125 aa, Artificial Sequence
  Description of Artificial Sequence: Synthetic heavy chain variable region amino acid sequence
EVQLVESGGGLVKPGGSLRLSCAASGFAFNNYYMNWVRQAPGKGLEWVSSISSASTYTDYADSVKGRFTISRDNAKNSLYLHLNSLRAEDTAVYYCARDYYGSGNYYNPKPLDVWGQGTTVTVSS

SEQ ID NO: 938 - protein, 110 aa, Artificial Sequence
  Description of Artificial Sequence: Synthetic light chain variable region amino acid sequence
QPVLTQPPSVSGAPGQRVTISCTGSSSNIGAGYDVHWYRQFPGTAPELLIYGNTNRPSGVPDRFSGSKSGTSASLAITGLQAEDEADYYCQSYDSSLKGVFGGGTKLTVL

SEQ ID NO: 939 - protein, 122 aa, Artificial Sequence
  Description of Artificial Sequence: Synthetic heavy chain variable region amino acid sequence
EVQLLESGGGLVKPGGSLRLSCAASGFKFRSYSMNWVRQAPGKGLEWVSSISSSSSYVDYAGSLKGRFTISRDNAENSLYLQMNSLRAEDTAMYYCARAGSVPVAGTYNDYWGQGTLVTVSS

SEQ ID NO: 940 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQHLPGTAPKLLIHGNNNRPAGVPDRFSGSKSGTSASLVITGLQADDEADYYCQSYDRSLSVLFGGGTKVTVL

SEQ ID NO: 941 - protein, 122 aa, Artificial Sequence
  Description of Artificial Sequence: Synthetic heavy chain variable region amino acid sequence
QVQLVQSGGGLVQPGGSLRLSCAASGFTFSSYEMNWVRQAPGKGLEWISYISSSGDTKYYADSVKGRFTVSRDNAKYSLYLQMDSLRAEDTAVYYCASLYDSRGYYWVFDYWGQGTLVTVSS

SEQ ID NO: 942 - protein, 107 aa, Artificial Sequence
  Description of Artificial Sequence: Synthetic light chain variable region amino acid sequence
DIVMTQSPSSLSASVGDRVTITCQASQDISTYLNWYQHKPGKAPNLLIYDASNLEPGVPSRFSGSGSGTDFTFTISSLQPEDIATYYCLQHDNLPPTFGQGTKVDIK

SEQ ID NO: 943 - protein, 116 aa, Artificial Sequence
  Description of Artificial Sequence: Synthetic heavy chain variable region amino acid sequence
QVQLVQSGAEVKKPGESLKISCKGSGYSFRSYWIAWVRQMPGKGLEWMGTIFPGDSDVTYSPSFQGQVTISVDKSTSTAYLQWGSLKASDTAIYYCARRYDYIDFWGQGTLVTVSS

SEQ ID NO: 944 - protein, 108 aa, Artificial Sequence
  Description of Artificial Sequence: Synthetic light chain variable region amino acid sequence
DIQMTQSPSSLSASVGDRVTITCQASQDIINHLNWYQQKPGKAPKLLIYDASNLHPGVPSRFSGSGSGTYFTFTISSLQPDDFATYYCQQYDFLAHITFGPGTKVDIK

SEQ ID NO: 945 - protein, 121 aa, Artificial Sequence
  Description of Artificial Sequence: Synthetic heavy chain variable region amino acid sequence
QVTLKESGAELRKPGESLKISCKASGYRFTNYWIGWVRQMPGKGLEWMGVIYPGDSDTKYSPSFQGQVTMSADKSINTAYLQWSSLKASDTAIYYCVSLFGDYDYGALDYWGQGTLVTVSS

SEQ ID NO: 946 - protein, 108 aa, Artificial Sequence
  Description of Artificial Sequence: Synthetic light chain variable region amino acid sequence
ETTLTQSPATLSMSPGERATLSCRASQSVGRNLAWYQQKPGQAPRLLIYGASIRATGILARFSGSGSGTEYTLTISSLQPEDFAVYYCQQYHDWPSFTFGPGTKVDIK

SEQ ID NO: 947 - protein, 121 aa, Artificial Sequence
  Description of Artificial Sequence: Synthetic heavy chain variable region amino acid sequence
EVQLVESGAEVKKPGESLKISCKASGYSFTRYWIGWVRQMPGKGLEWMGIIFPGDSDTRYCPSFEGQVTISADRSINTAYLQWSSLKASDSAMYYCVTLYTDYDYGAPDHWGQGTLVTVSS

SEQ ID NO: 948 - protein, 108 aa, Artificial Sequence
  Description of Artificial Sequence: Synthetic light chain variable region amino acid sequence
DIVLTQSPATLSVSPGERATLSCRASQSLSGDLAWYQQKPGQAPRLLIYATSTRATGIPARFSGSGSGAEFTLTISSLQSEDFAVYYCQQYYDWPLLTFGPGTKVEIK

SEQ ID NO: 949 - protein, 128 aa, Artificial Sequence
  Description of Artificial Sequence: Synthetic heavy chain variable region amino acid sequence
EVQLVQSGAEVKKPGGSVKVSCKASGYTFSEYYMHWVRQAPGQGPEWVGRINPKSGRTNYAQNFQGRVTMTRDRSISTVYMDLSRLRSDDTAVYYCARWEVMDYGSGIYYNQDHFDYWGQGTLVTVSS

SEQ ID NO: 950 - protein, 107 aa, Artificial Sequence
  Description of Artificial Sequence: Synthetic light chain variable region amino acid sequence
DIRVTQSPSSLSASVGDRVTITCRASQDITNYLAWFQQKPGKAPKSLMYAASTLQSGVPSRFSGSGSGTDFTLTISSLQPEDFATYYCQQYKTYPITFGQGTRLEIK

SEQ ID NO: 951 - protein, 118 aa, Artificial Sequence
  Description of Artificial Sequence: Synthetic heavy chain variable region amino acid sequence
QVQLVQSGPGLVKPSETLSLTCTVSAGSISNFYWSWIRQPPGKGLEWIGYIYYSGSTSYNPSLKSRVTISVDTSKNQFSLKLSSVTAADTAVYYCARSRSGWSLYDYWGQGTLVTVSS

SEQ ID NO: 952 - protein, 107 aa, Artificial Sequence
  Description of Artificial Sequence: Synthetic light chain variable region amino acid sequence
DIQVTQSPSSLSASVGDRVTITCRASQSISSFLNWYQQKPGKAPKLLIYVASSLQSGVPSRFSGSGSGTDFTLTISSLQPEDFATYYCQQSYNTPLTFGGGTKVDIK

SEQ ID NO: 953 - protein, 121 aa, Artificial Sequence
  Description of Artificial Sequence: Synthetic heavy chain variable region amino acid sequence
QVQLVQSGAEVKKPGESLKISCKGSGHSFATFWIGWVRQVPGNGLELMGIINLGDSDTKYSPSFQGQVTISADESIGTAYLQWSSLKASDTAMYYCARVSLPHYYYYMDVWGKGTTVTVSS

SEQ ID NO: 954 - protein, 107 aa, Artificial Sequence
  Description of Artificial Sequence: Synthetic light chain variable region amino acid sequence
DIVMTQSPSSVSASVGDRVTITCRASQGISTWLAWYRQKPGKAPELLIYAASRLQSGVPSRFSGSGSGTDFTLTISSLQPEDFATYYCQQANSFLGAFGPGTKLEIK

SEQ ID NO: 955 - protein, 122 aa, Artificial Sequence
  Description of Artificial Sequence: Synthetic heavy chain variable region amino acid sequence
EVQLVESGGGLVKPGGSLRLSCAASGFTLSGYYMSWVRQAPGKGLEWISYISGGSTYTNYADSVNGRFTISRDNAKNSLYLQMDSLRAEDTAVYYCARLEYGDYGPYYLGLWGRGTLVTVSS

SEQ ID NO: 956 - protein, 112 aa, Artificial Sequence
  Description of Artificial Sequence: Synthetic light chain variable region amino acid sequence
QSVLTQPPSVSGAPGQRVTISCTGTSSNIGAGYDVHWYQKLPGTAPKLLIYANNNRPSGVPDRFSGSKSGTSASLAITGLQAEDEADYYCQSYDTSLSAHYVFGTGTKLTVL

SEQ ID NO: 957 - protein, 122 aa, Artificial Sequence
  Description of Artificial Sequence: Synthetic heavy chain variable region amino acid sequence
QVQLVQSGGGVVQPGRSLRLSCAASGFTFSDYGMHWVRQAPGKGLEWVAVIWFDGSNKNYADSVKGRFTISRDNSMNTLYLQMNNLRAEDTAVYYCARAPYSFWSGYYLDYWGQGSLVTVSS

SEQ ID NO: 958 - protein, 107 aa, Artificial Sequence
  Description of Artificial Sequence: Synthetic light chain variable region amino acid sequence
DIVMTQSPATLSVSPGERATLSCRASQSISSNLAWYQQKSGQAPRLLIYGASTRATGIPARFSGSGSGTEFTLTISSLQSEDFAVYSCQQYSKWPQTFGQGTKVEIK

SEQ ID NO: 959 - protein, 125 aa, Artificial Sequence
  Description of Artificial Sequence: Synthetic heavy chain variable region amino acid sequence
EVQLVESGGGLVKPGGSLRLSCAASQFTFSTYDMSWVRQAPGKGLEWVASISSGSTYIYYADSVKGRFTISRDNAKHSLFLQMKSLRAEDTALYYCARQVLYDRGGYYLYYFDHWGQGTLVTVSS

SEQ ID NO: 960 - protein, 107 aa, Artificial Sequence
  Description of Artificial Sequence: Synthetic light chain variable region amino acid sequence
DIQVTQSPSSLSASVGDRVTITCRASQTIASYLNWYQQKPGKAPNLLIYAASNLQSGVPSRFSGSGSGTEFTLTINTLQPEDFATYYCQQSYNFPYTFGQGTKVEIK

SEQ ID NO: 961 - protein, 120 aa, Artificial Sequence
  Description of Artificial Sequence: Synthetic heavy chain variable region amino acid sequence
QVQLQQWGAGLSKPSETLSVTCAVYGGSLSGHYWSWFRQPPGKGLEWIGEIDHSGSTTYNPSLKSRVTISVDTSKNQFSLKLTSVTAADTAMYYCARATRYNYGYTFDYWGQGTLVTVSS

SEQ ID NO: 962 - protein, 107 aa, Artificial Sequence
  Description of Artificial Sequence: Synthetic light chain variable region amino acid sequence
DIPLTQSPSSLSASVGDRVTITCRASQIISSYLNWYQQKPGKAPKLLIYAASTLQSGVPSRFSGSRSGTDFTLTISSLQPEDFASYYCQQSYIIPFTFGPGTKVEIK

SEQ ID NO: 963 - protein, 124 aa, Artificial Sequence
  Description of Artificial Sequence: Synthetic heavy chain variable region amino acid sequence
QVQLQESGPGLVKPSETLSLTCTVSGGSIGNNFYYWGWIRQPPGKGLEWIGSIYYSGTTYDNPSLKSRVTISVEPSKNQFSLKLSSVTAADTAVYHCARRYCDSTRCYEAFDIWGQGTTVTVSS

SEQ ID NO: 964 - protein, 111 aa, Artificial Sequence
  Description of Artificial Sequence: Synthetic light chain variable region amino acid sequence
SYELTQPPSASGTPGQRVTISCSGSSSNIGSNYVSWYQQLPGTAPKLLIYKNDQRPSGVPDRFSGSKSGTSASLAISGLRSEDEAEYYCAAWDDSLSGFYVFGTGTKVTVL

SEQ ID NO: 965 - protein, 116 aa, Artificial Sequence
  Description of Artificial Sequence: Synthetic heavy chain variable region amino acid sequence
QVQLVQSGGGLVQPGGSLRLSCVASGFIFSSYEMNWVRQAPGKGLEWVSYISSSGSTIYYADSVKGRFTISRDNAKNSLYLQMNSLGAEDTAVYYCARAILYFDYWGQGTLVTVSS

SEQ ID NO: 966 - protein, 107 aa, Artificial Sequence
  Description of Artificial Sequence: Synthetic light chain variable region amino acid sequence
GIRLTQSPSSLSASVGDRVTITCRASQSITNYINWYQQKPGKAPKLLIYAISRLQSGVPSRFSGSGSGTDFTLTISSLQPEDFATYYCQQSYSTMYTFGQGTKVEIK

SEQ ID NO: 967 - protein, 121 aa, Artificial Sequence
  Description of Artificial Sequence: Synthetic heavy chain variable region amino acid sequence
EVQLVESGPGLVKPSETLSLTCTVSGGSISTYYWSWIRQPPGKGLEWIGYIYYTGSTNYNPSLKSRVTISLDTSKNQFSLKLSSVSAADTAFYYCARSPPVPGTRSWFDPWGQGTLVTVSS

SEQ ID NO: 968 - protein, 110 aa, Artificial Sequence
  Description of Artificial Sequence: Synthetic light chain variable region amino acid sequence
SPGLTQPQSAFGTPGQRVTISCFGSSSNIGRNHIYWYQQVPGTAPKLLIYRNNQRPSGVPDRFFGSKFGTSASLAISGVRSEDEADYFCAAWDDSLSGPVFGGGTKLTVL

SEQ ID NO: 969 - protein, 127 aa, Artificial Sequence
  Description of Artificial Sequence: Synthetic heavy chain variable region amino acid sequence
EVQLVESGGGLVQPGGSLRLSCAASGFTFSSYNIAWVRQAPGKGLEWISYISSSSSVIYYADSVRGRFTISRDNAKNSLYLQMNSLRDEDTAMYYCARAGNDYNFWSGRSSEYFDYWGQGTLVTVSS

SEQ ID NO: 970 - protein, 108 aa, Artificial Sequence
  Description of Artificial Sequence: Synthetic light chain variable region amino acid sequence
DIVMTQSPATLSVSPGERATLSCRASQSVSSNLAWYQQKPGQAPRLLIYGASTRATGIPARFSGSGSGTEFTLTISSLQSEDFAVYYCQQYDNWPLYTFGQGTKLEIK

SEQ ID NO: 971 - protein, 124 aa, Artificial Sequence
  Description of Artificial Sequence: Synthetic heavy chain variable region amino acid sequence
EVQLVESGAEVKKPGESLKISCKGSGYSFTTYWIGWVRQMPGKGLEWMGIMYPGDSQTRYSPSFQGQVTISADKSISTAYLQWSSLKASDTAMYYCARGGYCSGGSCYRGLDYWGQGTLVTVSS

SEQ ID NO: 972 - protein, 107 aa, Artificial Sequence
  Description of Artificial Sequence: Synthetic light chain variable region amino acid sequence
EIVMTQSPSSLSASVGDRVTITCRASQSISSFLNWYQQKPGKAPNLLIYAASSLLSGVPSRFSGSGSGTDFTLTISSLQPEDFATYYCQQSHSTPQTFGQGTKLEIK

SEQ ID NO: 973 - protein, 119 aa, Artificial Sequence
  Description of Artificial Sequence: Synthetic heavy chain variable region amino acid sequence
QVQLVQSGAEVKKPGSSVKVSCKASGGTFSSYPIIWVRQAPGQGLEWMGRIIPILGIASYAQKFQGRVTITADKSTSTAYMELSSLRSEDTAVYYCARNSDFYYGMDVWGQGTTVTVSS

SEQ ID NO: 974 - protein, 110 aa, Artificial Sequence
  Description of Artificial Sequence: Synthetic light chain variable region amino acid sequence
QSALIQPASVSGSPGQSITISCTGTSSDVGGYNYVSWYQHHPGKAPKLMIYDVSNRPSGISNRFSGSKSGNTASLTISGLQAEDEADYYCSSYTSSSLYVFGTGTKVTVL

SEQ ID NO: 975 - protein, 125 aa, Artificial Sequence
  Description of Artificial Sequence: Synthetic heavy chain variable region amino acid sequence
EVQLVESGGGLVQPGGSLRLSCAASGFTFSTFEFNWVRQAPGKGLEWLSYISSDDTTRYYADSVKGRFTISRDNAKNSLYLQMNSLRAEDTAYYYCVRGGPYDYVWGTYRYFDFWGQGTLVTVSS

SEQ ID NO: 976 - protein, 110 aa, Artificial Sequence
  Description of Artificial Sequence: Synthetic light chain variable region amino acid sequence
QSVLTQPASVSGSPGQSITISCTGTSSDIGGYNYVSWYQQHPGKAPKLMIYDVTNRPLGVSNRFSGSKSGNTASLIISGLQAEDEAEYYCCSYTSSNSLVFGGGTKLTVL

SEQ ID NO: 977 - protein, 128 aa, Artificial Sequence
  Description of Artificial Sequence: Synthetic heavy chain variable region amino acid sequence
EVQLVQSGAEVKKPGSSVKVSCKASGVTGGTFSSYAISWVRQAPGQGLEWMGGIMPMFGTTNYAQKFQGRVTITADKSTSTAYMELSSLRSEDTAVYYCARDYRDFSPHLDYYYMDVWGKGTTVTVSS

SEQ ID NO: 978 - protein, 108 aa, Artificial Sequence
  Description of Artificial Sequence: Synthetic light chain variable region amino acid sequence
DIRLTQSPGTLSLSPGERATLSCRASQSVSTSYLAWYQQKPGQAPRLLIYGASNRATGIPDRFSGSGSGTDFTLTISRLEPEDFAVYYCQQYGRTSWTFGQGTKVDIK

SEQ ID NO: 979 - protein, 117 aa, Artificial Sequence
  Description of Artificial Sequence: Synthetic heavy chain variable region amino acid sequence
QVQLVQSGGGVVQPGRSLRLSCAASGFPFHSYAMHWVRQAPGKGLEWVAVIWYEGSEKHYADSVQGRFTISRDNSKNMLYLQMNNLRVADTAVYYCARRGAWGFDIWGQGTTVTVSS

SEQ ID NO: 980 - protein, 112 aa, Artificial Sequence
  Description of Artificial Sequence: Synthetic light chain variable region amino acid sequence
DIVMTQTPLSLPVTPGEPASISCRSSQSVLHSTGYNSLDWYLQKPGQSPQLLIFLGSNRASGVPDRFSGSGSGTDFTLKISRVEAEDVGVYYCMQGLQTPYTFGQGTKVEIK

SEQ ID NO: 981 - protein, 125 aa, Artificial Sequence
  Description of Artificial Sequence: Synthetic heavy chain variable region amino acid sequence
QVQLVQSGGDLVQPGGSLRLSCAASGFTFSDYEVNWVRQAPGKGLEWLSYISSSGRIIHYADSVRGRFTISRDNAKNSLYLQMNSLRAEDTAVYYCARAAGQWLVTYYYYGMDVWGQGTTVTVSS

SEQ ID NO: 982 - protein, 107 aa, Artificial Sequence
  Description of Artificial Sequence: Synthetic light chain variable region amino acid sequence
QSVMTQSPSTLSASVGDTVTITCRASQSIINRLAWYQQKPGKPPKLLIYKSSSSESGVPSKFSGSGSGTEFTLTINSLQPDDFATYYCQHYNSYLYTFGQGTKVEIK

SEQ ID NO: 983 - protein, 116 aa, Artificial Sequence
  Description of Artificial Sequence: Synthetic heavy chain variable region amino acid sequence
EVQLVETGAEVKKPGESLKISCKGSGYSFTSYWIGWVRQMPGKGLEWMGIIYPGDSDTRYSPSFQGQVTISADKSISTAYLQWSSLKASDTAMYYCARRYDYIDIWGQGTMVTVSS

SEQ ID NO: 984 - protein, 108 aa, Artificial Sequence
  Description of Artificial Sequence: Synthetic light chain variable region amino acid sequence
DIRVTQSPSSLSASVGDRVTITCQASQDISNYLNWYQQKPGKAPKLLIYDASNLETGVPSRFSGSGSGTDFTFTISSLQPEDIATYYCQQYDNLAHITFGPGTKVEIK

SEQ ID NO: 985 - protein, 121 aa, Artificial Sequence
  Description of Artificial Sequence: Synthetic heavy chain variable region amino acid sequence
EVQLVQSGAEVKKPGASVKVSCKTSGYTFTGDYLHWVRQAPGQGLEWMGRLNPKSGGTVYAQRFQGRVTMTGDTSVTTAYMQLTRLRSDDTAIYYCARGIPVSGPVSIDYWGQGTLVTVSS

SEQ ID NO: 986 - protein, 110 aa, Artificial Sequence
  Description of Artificial Sequence: Synthetic light chain variable region amino acid sequence
QSVLTQPASLSGSPGQSITISCTGTSSDVGGYGYVSWYQQHPGKAPKLMIYDVANRPSGVSHRFSGSKSGNTASLTISGLQADDEADYYCSSYTRSNTVVFGGGTKLTVL

SEQ ID NO: 987 - protein, 120 aa, Artificial Sequence
  Description of Artificial Sequence: Synthetic heavy chain variable region amino acid sequence
EVQLVETGGGVVQPGRSLRLSCAASGFTFSSYGMHWVRQAPGKGLEWVAVISYDGSNKYYADSVKGRFTISRDNSKNTLYLQMNSLRTEDTAVYYCAKGGGYYYYYMDVWGKGTTVTVSS

SEQ ID NO: 988 - protein, 110 aa, Artificial Sequence
  Description of Artificial Sequence: Synthetic light chain variable region amino acid sequence
QPVLTQPASVSGSPGQSITISCTGTSSDVGGYNYVSWYQQHPGKAPKLMIYGVNNRPSGVSNRFSGSKSGNTASLTISGLQGEDEADYYCNSYRSGITVVFGGGTKLTVL

SEQ ID NO: 989 - protein, 127 aa, Artificial Sequence
  Description of Artificial Sequence: Synthetic heavy chain variable region amino acid sequence
EVQLVESGAEVKKPGESLKISCEAFGYSFTSYWIGWVRQVPGRGLEWIGVIYPGDSDIRYTPSFRGQVTISADRSISTAYLQWNNLKASDTAMYYCARPGRDINYYHSRDYGALDIWGQGTTVTVSS

SEQ ID NO: 990 - protein, 114 aa, Artificial Sequence
  Description of Artificial Sequence: Synthetic light chain variable region amino acid sequence
DIQLTQSPDSLAVSLGERVTINCKSSQSFLYSSNNKNYLAWYQQKPGQPPKLLIYWASVRESGVPDRFSGSGSGTDFTLTISSLQAEDVAVYYCQEYYSPPMFTFGQGTKVEIK

SEQ ID NO: 991 - protein, 119 aa, Artificial Sequence
  Description of Artificial Sequence: Synthetic heavy chain variable region amino acid sequence
EVQLLESGGGLIQPGGSLRLSCAASGFTFNNYVMSWVRQAPGKGLEWVAAISSSGVSTYYAASVKGRFTISRDNSKNMLYVQLNSLRAEDTAVYYCAKETGSYYYFDSWGQGTLVTVSS

SEQ ID NO: 992 - protein, 107 aa, Artificial Sequence
  Description of Artificial Sequence: Synthetic light chain variable region amino acid sequence
ETTLTQSPSTLSGSVGDRVTITCRASESISSWLAWYQQKPGKAPKLLIYKASNLESGVPSRFSGSGSGTEFTLTISSLQPDDFATYYCQQYNSYLITFGQGTRLEIK

SEQ ID NO: 993 - protein, 124 aa, Artificial Sequence
  Description of Artificial Sequence: Synthetic heavy chain variable region amino acid sequence
EVQLVESGPGLVKPSQTLSLTCTVSGGSISSGGDYWSWVRQRPGKGLEWIGYIYNSGSGYYNPSLKNRVSMSMHTSRNQFSLRLSSVTAADTAFYYCARDPFYRSGGIHYFDYWGQGALVTVSS

SEQ ID NO: 994 - protein, 108 aa, Artificial Sequence
  Description of Artificial Sequence: Synthetic light chain variable region amino acid sequence
DIVLTQTPGTLSLSPGEGATLSCRASPSVGSTSLAWYQQKPGQAPRLLIYGASSRATGIPDRFSGSGSGTDFTLTISRLEPEDFAVYYCQQDGGLPITFGLGTRLEIK

SEQ ID NO: 995 - protein, 127 aa, Artificial Sequence
  Description of Artificial Sequence: Synthetic heavy chain variable region amino acid sequence
EVQLLESGGGLVQPGGSLRLSCSASGFTFSVYAMHWVRLAPGKGLEYVSTISGNGGSTYYGDSVKGRFTTSRDNSKNTVYLQMSSLRAEDTAVYYCVKAPARDHYEILTLLGYFDYWGQGTLVTVSS

SEQ ID NO: 996 - protein, 114 aa, Artificial Sequence
  Description of Artificial Sequence: Synthetic light chain variable region amino acid sequence
DIVMTQSPDSLAVSLGERATINCKSSQSVLYSSSNKNYLAWYQQKPGQPPKLLIYWASTRESGVPDRFSGSGSGTDFTLTISSLQAEDVAVYYCQQYYTIPPWTFGQGTKVEIK

SEQ ID NO: 997 - protein, 122 aa, Artificial Sequence
  Description of Artificial Sequence: Synthetic heavy chain variable region amino acid sequence
QVQLVQSGAEMKKPGSSAKVSCKASGGTLSSYAINWVRQAPGQGLEWMGGIIPIFGTTKYAPKFQDRVTITVDESTSTAYMELSSLRSEDTAVYYCSRESSTWDVAHYFDYWGQGTLVTVSS

SEQ ID NO: 998 - protein, 107 aa, Artificial Sequence
  Description of Artificial Sequence: Synthetic light chain variable region amino acid sequence
DIVMTQTPSAISASVGDRVTITCRASQGISNYLAWVQQKPGKVPKRLIYGASSLQSGVPSRFSGSGSGTEFTLTISSLQPEDFATYYCLQHNSYPYTFGQGTKVEIK

SEQ ID NO: 999 - protein, 126 aa, Artificial Sequence
  Description of Artificial Sequence: Synthetic heavy chain variable region amino acid sequence
EVQLVESGAEVEKPGASVKVSCKASGYTFINYDIIWVRQAPGQGLEWMGWISGYKGNTNYAQKLQGRITMSTDTSTRTAYMELRSLTSDDTAVYYCARVGGTARSTTPYYYGMDVWGQGTTVTVSS

SEQ ID NO: 1000 - protein, 108 aa, Artificial Sequence
  Description of Artificial Sequence: Synthetic light chain variable region amino acid sequence
SYVLTQPPSVSVSPGQTARITCSGDAVPKQFSYWYQQKPGQAPVLVIYKDIERPSGIPERFSGSSSGTTVTLTISGVQAEDEADYYCQSAHTSGTYHVFGTGTKLTVL

SEQ ID NO: 1001 - protein, 117 aa, Artificial Sequence
  Description of Artificial Sequence: Synthetic heavy chain variable region amino acid sequence
EVQLLESGGGVVQPGRSLRLSCATSGFTFSSYGMHWVRQAPGKGLEWVAVIYYEGSNKYYGDSVKGRFTISRDNSKSTLYLQMNRLRAEDTAVYYCARRPAGGFDYWGPGTLVTVSS

SEQ ID NO: 1002 - protein, 112 aa, Artificial Sequence
  Description of Artificial Sequence: Synthetic light chain variable region amino acid sequence
EIVMTQSPLSLPVTPGEPASISCRSSQNLLNSNGYNYLDWYLQKPGQSPQLLIYLGSNRASGVPDRFSGSGSGTDFTLKISRVEAEDVGVYYCMQALQTPYTFGQGTKLEIK

SEQ ID NO: 1003 - protein, 129 aa, Artificial Sequence
  Description of Artificial Sequence: Synthetic heavy chain variable region amino acid sequence
EVQLVESGPGLVKPSETLSLTCTVSGGSIGNDYYYWGWIRQPPGKGLEWIGNISYSGSTYYNPSLKSRVTISVGTSKNQFSLKLTSVSAADTAVYHCVGRTFWRDCSSTSCYEYYFDYWGQGTLVTVSS

SEQ ID NO: 1004 - protein, 107 aa, Artificial Sequence
  Description of Artificial Sequence: Synthetic light chain variable region amino acid sequence
ETTLTQSPTSLSASVGDRVTITCRASQGISNYLAWYQQKPGKVPKVLIYAASTLQSGVSSRFSGSGSGTGFTLTISNLQPEDVATYYCQNYNSAPWTFGQGTKVEIK

SEQ ID NO: 1005 - protein, 130 aa, Artificial Sequence
  Description of Artificial Sequence: Synthetic heavy chain variable region amino acid sequence
QVQLVQSGAEVKKPGASVKVSCKASGYMFTGYYMHWVRQAPGQGLEWMGRINPNSGGTNYAQKFQGRVTMTRDTSISTGYMELSRLRSDDTAVYFCARDFFPLVIPTLIVGRGLYDMDVWGQGTMVTVSS

SEQ ID NO: 1006 - protein, 110 aa, Artificial Sequence
  Description of Artificial Sequence: Synthetic light chain variable region amino acid sequence
QPGLTQPPSASGTPGQRVTISCSGRSSNIGSNTVNWYQQLQGTAPKLLIYKNNQRPSGVPDRFSGSKSGTSASLAISGLQSEDEADYYCAAWDDSLNGVVFGGGTKVTVL

SEQ ID NO: 1007 - protein, 126 aa, Artificial Sequence
  Description of Artificial Sequence: Synthetic heavy chain variable region amino acid sequence
QVQLVESGAEVKKPGASVKVSCKASGYTFTDYYMHWVRQAPGQGLEWMGRINPNSGGTNYAQKFQGRVTMTRDTSISTAYMELSSLRSDDTAVYYCARDLTAGGYGSTWYSCGDYWGQGTLVTVSS

SEQ ID NO: 1008 - protein, 108 aa, Artificial Sequence
  Description of Artificial Sequence: Synthetic light chain variable region amino acid sequence
EIVLTQSPATLSVSPGERATLSCRASQSVSSNLAWYQQKPGQAPRLLIYGASTRATGIPARFSGSGSGTEFTLTISSLQSEDFAVYYCQQYNNWPRWTFGQGTKVEIK

SEQ ID NO: 1009 - protein, 118 aa, Artificial Sequence
  Description of Artificial Sequence: Synthetic heavy chain variable region amino acid sequence
QVQLVQSGAEVKKPGSSVKISCKASGGTFSSHPISWVRQAPGQGLEWMGRIVPIFGIANYAQKFQGRVTMIADKSTNTAYMELSNLRSEDTAVYYCANPVYDSSGFQWGQGTLVTVSS

SEQ ID NO: 1010 - protein, 110 aa, Artificial Sequence
  Description of Artificial Sequence: Synthetic light chain variable region amino acid sequence
QPVLTQPRSVSGSPGQSVTISCTGTSGDGGFYNYVSWYQQHPGKTPKLMIYDVDQRPSGVPDRFSGSKSGNTASLTISGLQAEDEADYYCCSYPGNPLYVFGTGTKVTVL

SEQ ID NO: 1011 - protein, 119 aa, Artificial Sequence
  Description of Artificial Sequence: Synthetic heavy chain variable region amino acid sequence
EVQLVQSGGGLVKPGGSLRLSCAASGFTFIDYYMSWIRQAPGKGLEWVSSISGGSTYTTYADSVKGRFTISRDNGKNSLYLQMDSLRAEDTAVYYCARLGGYSYYMDVWGKGTTVTVSS

SEQ ID NO: 1012 - protein, 110 aa, Artificial Sequence
  Description of Artificial Sequence: Synthetic light chain variable region amino acid sequence
QPVLTQPPSVSGAPGQRVTISCTGSSSNIGAGYDVHWYQHLPGAAPKLLIYDNTNRPSGIPDRFSGSKSGTSASLAITGLQAEDEADYYCQSYDSSLDWVFGGGTKVTVL

SEQ ID NO: 1013 - protein, 125 aa, Artificial Sequence
  Description of Artificial Sequence: Synthetic heavy chain variable region amino acid sequence
QVQLVQSGAEVKKPGSSVKVSCKASGGSFSSYTLNWVRQAPGQGLEWMGRFVPIVGIANYAQKFQGRVTITADKSTSTVYMELSSLRSEDTAVYYCATAPTAYCSGDCYSLFDPWGQGTLVTVSS

SEQ ID NO: 1014 - protein, 112 aa, Artificial Sequence
  Description of Artificial Sequence: Synthetic light chain variable region amino acid sequence
QSVLIQPASVSGSPGQSITISCTGISSDVGSYNLVSWYQQHPGKAPKLIIYEVNKRPSGVSNRFSGSKSGNTASLTISGLQAEDEADYYCCSYAVSRTSLYVFGTGTKVTVL

SEQ ID NO: 1015 - protein, 120 aa, Artificial Sequence
  Description of Artificial Sequence: Synthetic heavy chain variable region amino acid sequence
QVQLVQSGAEVKKPGESLKISCQGSGYSFTSYWIGWVRQMPGKDLEWMGIIYPSDSDTRYSPSFQGQVTISVDKSINTAYLQWTSLKASDTAMYYCARCDGAVYWYFDLWGRGTLVTVSS

SEQ ID NO: 1016 - protein, 109 aa, Artificial Sequence
  Description of Artificial Sequence: Synthetic light chain variable region amino acid sequence
EIVLTQSPATLSVSPGERVTLSCRASRSVSSHLAWYQQKPGQAPRLLMYGASTRATGIPARFSGSGSGTEFTLTISSLQSEDFGVYYCQQYNNWPPALTFGGGTKLEIK

SEQ ID NO: 1017 - protein, 125 aa, Artificial Sequence
  Description of Artificial Sequence: Synthetic heavy chain variable region amino acid sequence
QVQLQESGAGLVKPSETLSLTCGVYGESFSGHSWSWIRQPPGRGLEWIGEINQSGTTKYNPSLRSRVTISVDRSKNEFSLKVSSVTAADTAVYFCARYFRSFYTIGPDYYYMDVWGKGTTVTVSS

SEQ ID NO: 1018 - protein, 108 aa, Artificial Sequence
  Description of Artificial Sequence: Synthetic light chain variable region amino acid sequence
EIVLTQSPSSLSASVGDRVTITCRASQNINNYLNWYQQKPGKAPRLLIYAASSLQSGVPSRFTGSGSGTDFTLTIRSLQSEDFATYYCQHSYSSSLLTFGGGTKVDIK

SEQ ID NO: 1019 - protein, 125 aa, Artificial Sequence
  Description of Artificial Sequence: Synthetic heavy chain variable region amino acid sequence
EVQLLETGGGLVQPGGSLRLSCAASGFTFSSYDMNWVRQAPGKGLEWVSTISGSGGPTYYAGSVKGRFTISRDNSKNTLYLQMNSLRADDTAVYYCAKAQLYDTSGYYLYYFDYWGQGTLVTVSS

SEQ ID NO: 1020 - protein, 107 aa, Artificial Sequence
  Description of Artificial Sequence: Synthetic light chain variable region amino acid sequence
DIRMTQSPSSLSASVGDRVTITCRASQRITSYLNWYQQKPGKAPKLLIYAASSLQSGVPSRFSGSGSGTDFTLTISSLQPEDFATYFCQQSYSTSFTFGPGTKVDIK

SEQ ID NO: 1021 - protein, 125 aa, Artificial Sequence
  Description of Artificial Sequence: Synthetic heavy chain variable region amino acid sequence
QVQLQQWGAGLLKPSETLSLTCAVYGGSFSSYYYSWIRQPPGKGLEWIGEINQSGSTNYNPSLKSRVTISVDTSKNEFSLKLSSVTAADTAVYYCARIVREFNTRWYDYYYMDVWGKGTTVTVSS

SEQ ID NO: 1022 - protein, 110 aa, Artificial Sequence
  Description of Artificial Sequence: Synthetic light chain variable region amino acid sequence
DIRVTQSPATLSLSPGERATLSCRTSQSISSSYLAWYQQKFGQAPRLLIYGASSRATGIPDRFSGSGSGTDFTLTISRLEPEDFAVYYCQQYGISPPMYTFGQGTKVEIK

SEQ ID NO: 1023 - protein, 119 aa, Artificial Sequence
  Description of Artificial Sequence: Synthetic heavy chain variable region amino acid sequence
EVQLLESGAEVKKPGESLKISCKGSGYSFSSYWIAWVRQMPGKGLEWMGIIYPSDSDTKYSPSFQGQVTISADKSISTAYLQWSSLKASDTAMYYCARQAGIQRPLDYWGQGTLVTVSS

SEQ ID NO: 1024 - protein, 108 aa, Artificial Sequence
  Description of Artificial Sequence: Synthetic light chain variable region amino acid sequence
EIVMTQSPATLSVSPGERATLSCRASQSVRSNLAWYQQKPGQAPRLLIYDASTRATGISARFSGSGSGTEFTLTISSLQSEDFAVYYCQQFHNWPPYTFGQGTKVEIK

SEQ ID NO: 1025 - protein, 124 aa, Artificial Sequence
  Description of Artificial Sequence: Synthetic heavy chain variable region amino acid sequence
QVQLQQWGAGLLKSSETLSLTCAVYGGSFSGYYWSWIRQSPGKGLEWIGEINHSGSANYNPSLKNRVTISRDTSKNQFSLWLSSVTAADTAVYYCARTSRSPEPDNYYYYMDVWGRGTTVTVSS

SEQ ID NO: 1026 - protein, 111 aa, Artificial Sequence
  Description of Artificial Sequence: Synthetic light chain variable region amino acid sequence
QSVLTQPPSVSGAPGQRVSISCTGSSSDIGAGYDVHWYQQFPGTAPKLLMYANNNRPSGVPDRFSGSRSGTSASLAITGLQAEDEADYYCQSYDSNLDVVVFGGGTKLTVL

SEQ ID NO: 1027 - protein, 130 aa, Artificial Sequence
  Description of Artificial Sequence: Synthetic heavy chain variable region amino acid sequence
QVQLVESGGGLVKPGGSLRLSCAASGFTFSSYSMNWVRQAPGKGLEWVSSMSSSSGYIDYADSVKGRFTISRDNAKNSLYLQMNSLRVEDTAVYYCARRNAVVVPSLMVVADYYYGMDVWGQGTTVTVSS

SEQ ID NO: 1028 - protein, 113 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDTSLSGPGYVFGTGTKLTVL

SEQ ID NO: 1029 - protein, 126 aa, Artificial Sequence
  Description of Artificial Sequence: Synthetic heavy chain variable region amino acid sequence
QVQLVQSGAEVKKPGASVKVSCKAFGYTFRSYDMQWVRQAPGQRLEWMGWINAVNGDTKYSQKFQGRVTITRDTSATTVYMELSSLRSEDTAVYYCARWGRFWNSRSLDYYAMDVWGQGTTVTVSS

SEQ ID NO: 1030 - protein, 108 aa, Artificial Sequence
  Description of Artificial Sequence: Synthetic light chain variable region amino acid sequence
DIVMTQSPGTLSLSPGERATLSCRASQSISSSYLVWYQHKPGQAPRLLIYGASTRATDIPDRFSGSGSGTDFTLTISRLEPEDFAVYYCQQYGSSPLTFGQGTRLEIK

SEQ ID NO: 1031 - protein, 122 aa, Artificial Sequence
  Description of Artificial Sequence: Synthetic heavy chain variable region amino acid sequence
QVQLVQSGAEVKRPGASVKVSCKASGYIFSHYGISWVRQAPGQGLEWMAWISAYNGNTNYAQKLQGRVTVTTDTSTSTAYMELRSLRSDDTAVYYCAREPPSLSAAATLDYWGQGTLVTVSS

SEQ ID NO: 1032 - protein, 112 aa, Artificial Sequence
  Description of Artificial Sequence: Synthetic light chain variable region amino acid sequence
EIVMTQSPLSLPVTLGQPASISCRSNQSLVYSDGNIYLSWFQQRPGQSPRRLIYKVSNRDSGVPDRFSGSGSGTDFTLKISRVEAEDVAVYYCMQVTHWPHEFGQGTKLEIK

SEQ ID NO: 1033 - protein, 125 aa, Artificial Sequence
  Description of Artificial Sequence: Synthetic heavy chain variable region amino acid sequence
QVQLVQSGAEVKKPGASVKVSCRTSGYTFTDYEINWVRQAPGQGLEWMGGISAYNGKTDYAQNLQDRVTMTTDTSTSTAYMELRSLRSDDTAVYYCARIFYYDRSGYYLALFDSWGHGTLVTVSS

SEQ ID NO: 1034 - protein, 108 aa, Artificial Sequence
  Description of Artificial Sequence: Synthetic light chain variable region amino acid sequence
DIQMTQSPSSLSASVGDRVTITCRASQRIASYLNWYQQKPGKAPKLLIYAASSLQSGVPSRFSGSGSGTDFTLTISSLQPEDFATYYCQQSYSTPTLTFGGGTKMDIK

SEQ ID NO: 1035 - protein, 122 aa, Artificial Sequence
  Description of Artificial Sequence: Synthetic heavy chain variable region amino acid sequence
EVQLVESGGGLVKPGMSLRLSCAASGFRFSDHYMNWIRQAPGKGLEWVSYISSSSTYTDYTDSVKGRFTISRDNSKNSVYLQMNSLRAEDTAIYYCARVAPIRHNGDYIDYWGQGTTVTVSS

SEQ ID NO: 1036 - protein, 111 aa, Artificial Sequence
  Description of Artificial Sequence: Synthetic light chain variable region amino acid sequence
NFMLTQPPSASGTPGQRVTISCTGSSSNIGAGYDVHZYQQIPGTAPKLLIYGNNNRPSGVPDRFSGSKSGTSASLAITGLQTEDEADYYCQSYDRGLSGRVFGTGTKVTVL

SEQ ID NO: 1037 - protein, 123 aa, Artificial Sequence
  Description of Artificial Sequence: Synthetic heavy chain variable region amino acid sequence
QVQLQESGPGLVKPSQMLSLTCTVSGDSISSGDYYWSWIRHHPGKGLEWIGYISYSGSTYNNPSLKSRVTVSVDTSKNQFFLKLTSVTAADTAVYYCARATKPYHSYFYMDVWGKGTTVTVSS

SEQ ID NO: 1038 - protein, 107 aa, Artificial Sequence
  Description of Artificial Sequence: Synthetic light chain variable region amino acid sequence
EIVLTQSPGTLSLSPGERATLSCRASQSGSRSYLAWYQQRPGQAPRLLIYGASNRATGIPDRFSGSGSGTDFTLTISRLEPEDFAVYYCQQYGNAPTFGGGTKVDIK

SEQ ID NO: 1039 - protein, 131 aa, Artificial Sequence
  Description of Artificial Sequence: Synthetic heavy chain variable region amino acid sequence
EVQLVESGGGLVQPGGSLRLSCIVSGFPFNTYAMSWVRQAPGKGLEWVSVVSASGGNTDYADSVKGRFTISRDNSKKTLYLQMNSLRAEDTAVYYCARTESNTLAPSWSGRYVTDWYFDLWGRGTLVTVSS

SEQ ID NO: 1040 - protein, 106 aa, Artificial Sequence
  Description of Artificial Sequence: Synthetic light chain variable region amino acid sequence
EIVMTQSPSSLSASVGDRVTITCRASQSISSFLNWYQQKPGKAPKLLISAASSLQSGVPSRFSGSGSGTDFTLTISSLQPEDFATYYCQQSYSIPTFGQGTRLEIK

SEQ ID NO: 1041 - protein, 126 aa, Artificial Sequence
  Description of Artificial Sequence: Synthetic heavy chain variable region amino acid sequence
QVQLVQSGAEVKKPGASVKVSCKASGYTFSGYYMHWVRQAPGQGLEWVGRINPKSGDTVYAQKFQGRVTMTRDTSISTAYMELSRLISDDTAKYYCARQEDHYYGSGNFYNSFDFWGQGTLVTVSS

SEQ ID NO: 1042 - protein, 108 aa, Artificial Sequence
  Description of Artificial Sequence: Synthetic light chain variable region amino acid sequence
ETTLTQSPSSLSASVGDRVTITCRASQSISSNLNWYQQKPGKAPKLLIYGASTLQSGVPSRFSGSGSGTDFTLTISSLQPEDLATYYCQQSYSNPGKTFGQGTKVDIK

SEQ ID NO: 1043 - protein, 129 aa, Artificial Sequence
  Description of Artificial Sequence: Synthetic heavy chain variable region amino acid sequence
EVQLVQSGGVVIQPGGSLRLSCAASGFSFDEYLMHWVRQLPGKGLEWVALISWHGDITYYADSVKGRFTISRDNSRYSLYLQMNSLRSDDTALYYCVKDGWIEGAFNHTFGIGYYFENWGQGTLVTVSS

SEQ ID NO: 1044 - protein, 107 aa, Artificial Sequence
  Description of Artificial Sequence: Synthetic light chain variable region amino acid sequence
DIVLTQTPSSLSASVGDRVTITCQASQDINNCLNWYQQKPGKAPEVLIFDASNLETGVPLRFSGSGSGTHFTLTISSLQPEDIATYYCQQHENVPLTFGGGTKVEIK

SEQ ID NO: 1045 - protein, 124 aa, Artificial Sequence
  Description of Artificial Sequence: Synthetic heavy chain variable region amino acid sequence
QVQLVESGGGLVKPGGSLRLSCGASGFTFPDYYMSWIRQAPGKGLEWLSYISSSSSFTDYADSVKGRFTISRDNAKKSLYLQMNSLRAEDTAVYYCARVRADYVGNSRIHFDYWGQGTLVTVSS

SEQ ID NO: 1046 - protein, 107 aa, Artificial Sequence
  Description of Artificial Sequence: Synthetic light chain variable region amino acid sequence
DIVMTQSPVTLSVSPGERATLSCRASQSLNGYLAWYQQKPGQAPRLLIYGASTRATEPGWDTSGRGSGTEFTLTISSLQSEDFAVYYCQQYNDWPFTFGQGTRLEIK

SEQ ID NO: 1047 - protein, 123 aa, Artificial Sequence
  Description of Artificial Sequence: Synthetic heavy chain variable region amino acid sequence
EVQLLESGGGLVKPGGSLRLSCAASGLTFSDHDMSWVRQAPGKGLEWVSGIGGSGSNTYYAGSVKGRFTISRDNSKNTLYLQMDSLRVEDTAVYYCAKDPYGDYRDYYGMDVWGQGTTVTVSS

SEQ ID NO: 1048 - protein, 112 aa, Artificial Sequence
  Description of Artificial Sequence: Synthetic light chain variable region amino acid sequence
DIVLTQTPFSLPVTPGEPASISCRSSQSLLKSNGYNYLDWFLQKPGQSPQLLIYLGSNRASGVPDRFSGSGSGTDFTLKISRVEAEDVGVYYCMQTLQALYTFGQGTKVEIK

SEQ ID NO: 1049 - protein, 123 aa, Artificial Sequence
  Description of Artificial Sequence: Synthetic heavy chain variable region amino acid sequence
EVQLLESGGGLVQPGGSLRLSCAASGFAFDIYSMNWVRQAPGKGLEWLSYISSRGETIYYADSVKGRFTISRDNARNSLYLQMNGLRDEDTATYYCYYYGSGISSHGGAFDYWGQGTLVTVSS

SEQ ID NO: 1050 - protein, 108 aa, Artificial Sequence
  Description of Artificial Sequence: Synthetic light chain variable region amino acid sequence
DIVMTQTPATLSLSPGERATLTSRASQSVSSFLAWYQQKPGQAPRLLIYDVSNRATGVPARFSGSGSGTDFTLTISSLEPEDIAVYYCQQRNTWPAITFGQGTKVEIK

SEQ ID NO: 1051 - protein, 118 aa, Artificial Sequence
  Description of Artificial Sequence: Synthetic heavy chain variable region amino acid sequence
QVQLVESGAEVKKPGSSVKISCKASGGTFSSHPISWVRQAPGQGLEWMGRIVPIFGIANYAQKFQGRVTMIADKSTNTAYMELSNLRSEDTAVYYCASPVYDSSGFQWGQGTLVTVSS

SEQ ID NO: 1052 - protein, 110 aa, Artificial Sequence
  Description of Artificial Sequence: Synthetic light chain variable region amino acid sequence
QSALIQPRSVSGSPGQSVTISCTGTSGDGGFYNYVSWYQQHPGKTPKLMIYDVDQRPSGVPDRFSGSKSGNTASLTISGLQAEDEADYYCCSYPGNPLYVFGTGTKLTVL

SEQ ID NO: 1053 - protein, 121 aa, Artificial Sequence
  Description of Artificial Sequence: Synthetic heavy chain variable region amino acid sequence
QVQLVQSGAEVRKPGESLKISCKASGYRFTNYWIGWVRQMPGKGLEWMGVIYPGDSDTRYSPSFQGQVTMSADKSTNTAYLQWSSLKASDTAIYYCVSLYSDYDYGALDYWGQGTLVTVSS

SEQ ID NO: 1054 - protein, 108 aa, Artificial Sequence
  Description of Artificial Sequence: Synthetic light chain variable region amino acid sequence
EIVMTQSPATLSVSPGERATLSCRASENVGRNLAWYQQKPGQAPRLLIYGASIRATGILARFSGSGSGTEYTLTISSLQSEDFAVYYCQQYHDWPSFTFGPGTKVDIK

SEQ ID NO: 1055 - protein, 121 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISAGSSYIYYADSVKGRFTISRDNAKNSLYLQMNSLRAEDTAVYYCARVPSYETTPYFDYWGQGTLVTVSS

SEQ ID NO: 1056 - protein, 111 aa, Artificial Sequence
  Description of Artificial Sequence: Synthetic light chain variable region amino acid sequence
QSVLTQPPSVSGAPGQRVTISCTGSSSNIGSGYDLHWYQQLPGTAPKLLIYVNSNRPSGVPDRFSGSKSGTSASLAITGLQAEDEADYYCQSYDSSLSGYVFGTGTKVTVL

SEQ ID NO: 1057 - protein, 125 aa, Artificial Sequence
  Description of Artificial Sequence: Synthetic heavy chain variable region amino acid sequence
QVQLQESGPGLVKPSGTLSLTCAVSGGSISSTNWWSWVRQPPGKGLEWIGEIYHSGSTNYNPSLKSRVTISVDKSNNQFSLNLSSVTAADTAVYYCARGVITYRGSWFLQYFDYWGQGTLVTVSS

SEQ ID NO: 1058 - protein, 113 aa, Artificial Sequence
  Description of Artificial Sequence: Synthetic light chain variable region amino acid sequence
DIRVTQSPDSLAVSLGERATINCKSSQSLFYSSNNQNYLAWYQQKPGQPPKLLIYWASTRQSGVPHRFSGSGSGTDFTLTISSLQAEDVAVYYCQQYYSSPLTFGGGTKVEIK

SEQ ID NO: 1059 - protein, 125 aa, Artificial Sequence
  Description of Artificial Sequence: Synthetic heavy chain variable region amino acid sequence
EVQLLESGGGLVKPGGSLRLSCAGSGFSFSSYSMNWVRQAPEKGLEWVSSISASSSFINYADSVKGRFIISRDNAKNSLFLQMDSLRAEDTAVYYCARDGVHPGGYIFGGYIDSWGQGTLVTVSS

SEQ ID NO: 1060 - protein, 111 aa, Artificial Sequence
  Description of Artificial Sequence: Synthetic light chain variable region amino acid sequence
QSVLTQPPSVSGAPGQRVTISCTGSSSNIGAGYDVHWFRQLPGTAPKLLIYGNNNRPSGVPDRFSGSKSGSSASLIITGLQAQDEATYYCQSYDSSLSGYVFGTGTKLTVL

SEQ ID NO: 1061 - protein, 127 aa, Artificial Sequence
  Description of Artificial Sequence: Synthetic heavy chain variable region amino acid sequence
QVQLVQSGPALVKPTQTLTLTCTFSGFSLSTKGMCVSWIRQPPGKALEWLALIDWDDDKFYSTSLKTRLTISKDTSKNQVVLTMTNMDPVDTATYYCARTLYFYGSGSLSDYCFDYWGQGTPVTVSS

SEQ ID NO: 1062 - protein, 110 aa, Artificial Sequence
  Description of Artificial Sequence: Synthetic light chain variable region amino acid sequence
QPVLTQPRSVSGSPGQSVTISCTGTSRDVGNYNFVSWYQQHPGKAPKLIIYDVTKRPSGVPDRFSGSKSGNTASLTISGLQAEDEADYYCCSYAGTYTWVFGGGTKVTVL

SEQ ID NO: 1063 - protein, 122 aa, Artificial Sequence
  Description of Artificial Sequence: Synthetic heavy chain variable region amino acid sequence
QVQLVESGGDLVKPGGSLRLSCAASGFTLSGHYMSWIRQPPGKGLEWVSSISGGSTYTNYADSVKGRFTISRDNAENSLYLQMNSLRAEDTAVYYCARLAYSDYGPFYFDLWGRGTLVTVSS

SEQ ID NO: 1064 - protein, 112 aa, Artificial Sequence
  Description of Artificial Sequence: Synthetic light chain variable region amino acid sequence
QSVLTQPPSVSGAPGQRVTISCTGSSSNIGAGYDVHWYQQLTGTAPKLLIFDNNNRPSGVPDRFSGSKSGTSASLAITGLQAEDEADYYCQSYDSRLSAPYVFGTGTKLTVL

SEQ ID NO: 1065 - protein, 115 aa, Artificial Sequence
  Description of Artificial Sequence: Synthetic heavy chain variable region amino acid sequence
QVQLQESGAGLLKPSETLSLTCAVSGASFSGYSWSWIRQPPGKGLEWIGDIDHSGSTNYNSSLNSRVTISVDTSKNQFSLNLTSVTAADTAIYYCARVGGRSAYWGQGTLVTVSS

SEQ ID NO: 1066 - protein, 111 aa, Artificial Sequence
  Description of Artificial Sequence: Synthetic light chain variable region amino acid sequence
DIVMTQSPLSLPVTPGEPASISCRSSQSLLHSNGFNYLDWYLQKPGQSPQLLIYLGSNRASGVPDRFSGSGSGTDFTLKISRVEAEDVGVYYCMQALQTLTFGGGTKVEIK

SEQ ID NO: 1067 - protein, 122 aa, Artificial Sequence
  Description of Artificial Sequence: Synthetic heavy chain variable region amino acid sequence
QVQLVQSGAEVKKPGASVKVSCKASGYTFNNYGISWVRQAPGQGLEWMGWISAYNGDIKYAQKFQGRVTVTTDTSTSTAYMELRSLRSDDTAVYYCARDTPVGGGTQTFDYWGQGTLVTVSS

SEQ ID NO: 1068 - protein, 112 aa, Artificial Sequence
  Description of Artificial Sequence: Synthetic light chain variable region amino acid sequence
ETTLTQSPLSLPVTLGQPASISCRSSQSLVHSNGNTYLNWFQQRPGQSPRRLIYTVSNRDSGVPDRFSGSGSGTDFTLKISRVEAEDVGVYYCMQATHRPGTFGQGTKVEIK

SEQ ID NO: 1069 - protein, 118 aa, Artificial Sequence
  Description of Artificial Sequence: Synthetic heavy chain variable region amino acid sequence
EVQLLESGAEVKKPGASVKVSCKASGYTFTDYYIHWVRQAPGQGLEWMGRINPKNGDAIYAQNFQGRVTMTRDTSISTAYMEVSRLTSDDTAVYYCARDQMWLVLDYWGQGTLVTVSS

SEQ ID NO: 1070 - protein, 110 aa, Artificial Sequence
  Description of Artificial Sequence: Synthetic light chain variable region amino acid sequence
QSALTQPASVSGSPGQSITISCTGTSSDVGGYDYVSWYQQHPGKAPKLMIHDVTNRPSGISHRFSGSKSGNTASLTISGLQAGDEADYYCSSYTRSNTKVFGTGTKVTVL

SEQ ID NO: 1071 - protein, 121 aa, Artificial Sequence
  Description of Artificial Sequence: Synthetic heavy chain variable region amino acid sequence
EVQLVESGGGLIQPGGSLRLSCAASGFTVSSNYMSWVRQAAGKGLEWVSLIYSGDSTYYADSVKGRFTISRDNSQNTLYLQMNSLRAEDTAVYYCARDASPNVGYYGMDVWGQGTTVTVSS

SEQ ID NO: 1072 - protein, 108 aa, Artificial Sequence
  Description of Artificial Sequence: Synthetic light chain variable region amino acid sequence
DIVLTQPPSVSVSPGQTASITCSGGKLGDTYACWYQQKPGQSPVLVIYQDSKRPSGIPERFSGSNSGNTATLTISGTQAMDEADYYCQAWDSSTARYVFGTGTKVTVL

SEQ ID NO: 1073 - protein, 132 aa, Artificial Sequence
  Description of Artificial Sequence: Synthetic heavy chain variable region amino acid sequence
EVQLVESGGGLVQPGGSLRLSCAASGFTFSSYWMSWVRQAPGKGLEWVATIKQDGSEKYSVDSVKGRFTISRDNPKKSLYLQMNSLRAEDTAVYYCARDYRVEYYHSSDKLKRYYYYGMDVWGQGTTVTVSS

SEQ ID NO: 1074 - protein, 107 aa, Artificial Sequence
  Description of Artificial Sequence: Synthetic light chain variable region amino acid sequence
DIRVTQSPSSLSASVGDRVTITCRASQSISTYLNWYQQKPGKAPKFLIYAASSLESGVPSRFSGSGSGTDFSLTISSLQPEDFATYYCQQSYSIPITFGQGTRLEIK

SEQ ID NO: 1075 - protein, 123 aa, Artificial Sequence
  Description of Artificial Sequence: Synthetic heavy chain variable region amino acid sequence
QVQLVESGGGVVRPGGSLRLSCAASGFTFDDYGMSWVRQAPGKGLEWVSGINWSGGSTDYADSVKGRFTISRDNAKNSLYLQMNSLRAEDTALYYCAKEGQEWELLPWYFDLWGRGTLVTVSS

SEQ ID NO: 1076 - protein, 110 aa, Artificial Sequence
  Description of Artificial Sequence: Synthetic light chain variable region amino acid sequence
QPVLTQPASVSGSPGQSITIPCTGTSSDVGIYNLVSWYQQHPGKAPKLMIYDVSKRPSGVSNRFSGSKSGNTASLTISGLQAEDEADYYCCSYAGGSTYVFGTGTKLTVL

SEQ ID NO: 1077 - protein, 119 aa, Artificial Sequence
  Description of Artificial Sequence: Synthetic heavy chain variable region amino acid sequence
EVQLVESGGGLVKPGESLRLSCAASGFRFSDHYMSWIRQAPGKGLEWISYISSSSSYIHYADSVTGRFTISRDNAKNSMYLQMNSLRAEDTAVYYCAREIGRSYYMDVWGKGTTVTVSS

SEQ ID NO: 1078 - protein, 112 aa, Artificial Sequence
  Description of Artificial Sequence: Synthetic light chain variable region amino acid sequence
QSALIQPPSVSGAPGQRVTISCTGSSSNIGAGYDVHWYQQLPGTAPKLLIYGNNNRPSGVPDRFSASKSGISASLAITGVQTEDEADYYCQSYDRSLSEFYVFGSGTKVTVL

SEQ ID NO: 1079 - protein, 126 aa, Artificial Sequence
  Description of Artificial Sequence: Synthetic heavy chain variable region amino acid sequence
EVQLVQSGGGLVKPGGSLRLSCVASGFTFSSYSMNWVRQAPGKGLEWVSSISASSSYIDYADSVKGRFTISRDNDKKSLYLQMSSLRAEDTAVYYCAREDYDSLTGYYSPKRFDPWGQGTLVTVSS

SEQ ID NO: 1080 - protein, 110 aa, Artificial Sequence
  Description of Artificial Sequence: Synthetic light chain variable region amino acid sequence
QSVLTQPPSLSGAPGQRVTISCTGSSSNIGAGYDVHWYQQLPGTAPKLLIYGNNNRPSGVPDRFSGSKSGTSASLAITGLQAEDEADYYCQSYDRSLSVVFGGGTKVTVL

SEQ ID NO: 1081 - protein, 119 aa, Artificial Sequence
  Description of Artificial Sequence: Synthetic heavy chain variable region amino acid sequence
QVQLVQSGAEVKKPGASVKVSCKASGYTFISDGISWVRQAPGQGLEWMGWINPHNENTNYAQKFQGRVTMTTDTSTSTAYLELRGLRSDDTAVYYCARDPYHWSYLDYWGQGTLVTVSS

SEQ ID NO: 1082 - protein, 112 aa, Artificial Sequence
  Description of Artificial Sequence: Synthetic light chain variable region amino acid sequence
QSVVTQPPSVSGAPGQRVTITCTGSSSNIGANSDVHWYQQIPGTAPKLLIFGNSNRPSGVPDRFSGSKSGTSASLAITGLQAEDEADYYCQSYDRSLSGSRVFGGGTRLTVL

SEQ ID NO: 1083 - protein, 122 aa, Artificial Sequence
  Description of Artificial Sequence: Synthetic heavy chain variable region amino acid sequence
EVQLVESGGGLVQPAGSLRLSCAASGFTFSNYVMNWVRQAPGKGLEWVSYISSSGRTIHYADSVKGRFTISRDNAKNSLYLEMNSLRAEDTAVYYCARDPNYGGNSNRFDSWGQGTLVTVSS

SEQ ID NO: 1084 - protein, 108 aa, Artificial Sequence
  Description of Artificial Sequence: Synthetic light chain variable region amino acid sequence
DIVMTQTPSSLSASVGDRVTITCRASQTISNYLNWYQQKPGKAPKLLIFAASSLQSGVPSRFSGSGSGTDFTLTISSLQPEDFATYYCQQSYSAPRVTFGPGTKVDIK

SEQ ID NO: 1085 - protein, 126 aa, Artificial Sequence
  Description of Artificial Sequence: Synthetic heavy chain variable region amino acid sequence
EVQLLESGGGLVKPGGSLRLSCAASGFTFSDYTMNWVRQAPGKGLEWVSSISITSSHIYYADSVKGRFTISRDNAKNSLYLQINSLRAEDTAAYYCARELGFASSSYSYYYGMDVWGQGTTVTVSS

SEQ ID NO: 1086 - protein, 108 aa, Artificial Sequence
  Description of Artificial Sequence: Synthetic light chain variable region amino acid sequence
QSALTQPRSVSGSPGQSVTISCTGTSSDVGDYNSVSWYQQHPGTAPKLIIFDVTQRPSGVPDRFSGSKSANTASLTISGLQPEDEADYYCCSFAGNYVFGTGTKVTVL

SEQ ID NO: 1087 - protein, 120 aa, Artificial Sequence
  Description of Artificial Sequence: Synthetic heavy chain variable region amino acid sequence
QVTLKESGGGVVQPGRSQRLSCTASGFNFHNYAMHWVRQAPGKGLEWVAVISYDGSNKNFADSVKGRFTISRDNSKNTLNLQMNNLRAEDTAVYYCVRDIVRGSPLFDYWGQGTLVTVSS

SEQ ID NO: 1088 - protein, 108 aa, Artificial Sequence
  Description of Artificial Sequence: Synthetic light chain variable region amino acid sequence
QPVLTQPPSLSVAPGQTAWITCGGNNIGSKIVHWYQQKPGQAPVVVVYDDDDRPSGIPERFSGSNSGNTATLTIRRVEVGDEADYYCQVWDRSSDNYVFGTGTKVSVL

SEQ ID NO: 1089 - protein, 124 aa, Artificial Sequence
  Description of Artificial Sequence: Synthetic heavy chain variable region amino acid sequence
QVQLVESGGGVVQPGRSLRISCAASGFTFSNYGMHWVRQAPGKGLEWVAVLSYDGSNEYYADSVKGRFTISRDNSKNTLYLQMNSLRAEDTAVYYCAKNLNDYNISWYKCFDLWGRGTLVTVSS

SEQ ID NO: 1090 - protein, 111 aa, Artificial Sequence
  Description of Artificial Sequence: Synthetic light chain variable region amino acid sequence
QPVLTQPASVSGSPGQSITISCTGTSSDVGGYNYVSWYQHHPGKAPKLIIYDVNNRPSGVSNRFSGSKSGNTASLTISGLQAEDEADYICSSYTTITTFVVFGGGTKLTVL

SEQ ID NO: 1091 - protein, 118 aa, Artificial Sequence
  Description of Artificial Sequence: Synthetic heavy chain variable region amino acid sequence
EVQLVETGGGLVQPGRSLRLSCTASGFTFGDYAMNWVRQAPGKGLEWIGIIRTKTYGGTTEYAASVKGRFTISRDDSKGIAYLQMNSLKTEDTGVYYCTMPVLNMDVWGQGTTVTVSS

SEQ ID NO: 1092 - protein, 111 aa, Artificial Sequence
  Description of Artificial Sequence: Synthetic light chain variable region amino acid sequence
QPVLTQPHSVSESPGKTVTISCTRNIGNIASNYVQWYQQRPGSSPTTVIYEDNQRPSGVPDRFSGSIDISSNSASLTISGLKTEDEADYYCQSYDSNNPWVFGGGTQLTVL

SEQ ID NO: 1093 - protein, 122 aa, Artificial Sequence
  Description of Artificial Sequence: Synthetic heavy chain variable region amino acid sequence
EVQLVESGGGLVKPGGSLRLSCAASGFSLSDYYMTWLRQAPGKGLEWVSSIGTTSTYTNYAESVKDRFTISRDNAKNSLYLQMNSLRAEDTAVYYCARDWGFGVERGYFDLWGRGTLVTVSS

SEQ ID NO: 1094 - protein, 107 aa, Artificial Sequence
  Description of Artificial Sequence: Synthetic light chain variable region amino acid sequence
DIVLTQTPSTLSASVGDRVTITCRASQSISFWLAWYQQKPGKAPKLLIYKASTLESGVPSRFSGRGSGTDFTLTISSLQPDDFATYYCQQYNTYTWTFGQGTKVEIK

SEQ ID NO: 1095 - protein, 121 aa, Artificial Sequence
  Description of Artificial Sequence: Synthetic heavy chain variable region amino acid sequence
EVQLVESGGGLVKPGGSLRLSCAASRFTFAGYYMSWIRQAPGKGLEWVSDISPSSTYTNYADSVKGRFTISRDNAGTSVSLQMDSLRADDTAVYYCARITPYGGSHYFDSWGQGTLVTVSS

SEQ ID NO: 1096 - protein, 112 aa, Artificial Sequence
  Description of Artificial Sequence: Synthetic light chain variable region amino acid sequence
QPVLTQPPSVSGAPGQRVTISCTGSSSNIGAGYDLHWYQQLPGTAPKLLIYGNSNRPSGVPDRFSGSKSGTSASLAITGLQAEDEADYYCQSYDNSLSGFYVFGTGTKVTVL

SEQ ID NO: 1097 - protein, 130 aa, Artificial Sequence
  Description of Artificial Sequence: Synthetic heavy chain variable region amino acid sequence
RSSWCSVGAEVKKRGSSVKVSCKASGGTFGGYAVSWVRQAPGQGLEWMGGIIPMFYTTKYAQKLQGRVTITADESTNTAYMDLSSLTSDDTAIYFCAREWHLGRTAVTGTGAFLDAFDIWGQGTMVTVSS

SEQ ID NO: 1098 - protein, 110 aa, Artificial Sequence
  Description of Artificial Sequence: Synthetic light chain variable region amino acid sequence
SYELTQPPSVSEAPRQRVTISCSGSSSNIGNNAVNWYQQLPGKAPKLLIYYDDLLPSGVSDRFSGSKSGTSASLAISGLQSEDEADYYCSAWDDSLNGWVFGGGTKLTVL

SEQ ID NO: 1099 - protein, 119 aa, Artificial Sequence
  Description of Artificial Sequence: Synthetic heavy chain variable region amino acid sequence
EVQLLESGPGLVKPSETLSLTCTVSGGSISSYQWNWIRQPPGKGLEWLGYVYYSGSTNYNPSLKSRVTLSVDTSKNQFSLKLSSVTAADTAVYYCARDRRDGSFVFDYWGQGTLVTVSS

SEQ ID NO: 1100 - protein, 110 aa, Artificial Sequence
  Description of Artificial Sequence: Synthetic light chain variable region amino acid sequence
QSVLIQPASVSGSPGQSITISCTGTSSDVGGYNYVSWYQQHPGKAPKLMIYDVSNRPSGISNRFSGSKSGNTASLTISGLQAEDEADYYCSSYTSSTTLVFGTGTKVTVL

SEQ ID NO: 1101 - protein, 123 aa, Artificial Sequence
  Description of Artificial Sequence: Synthetic heavy chain variable region amino acid sequence
QVQLVQSGGGVVQPGRSLKLSCAASGFTFKSYGMHWVRQAPGKGLEWVAVISYDEINKYYADSVKGRFTISRDYSKNTLSLQMNSLTTEDTAMYYCAKPKTTGYYYLDAFDFWGQGTMVTVSS

SEQ ID NO: 1102 - protein, 107 aa, Artificial Sequence
  Description of Artificial Sequence: Synthetic light chain variable region amino acid sequence
ETTLTQSPSSLSASVGDRVTITCQASQDISNYLNWYQQKPGKAPKLLIYDASNLETGVPSRFSGSGSGTDFTFTISSLQSEDIATYYCQQHDNVPPTFGQGTKVDIK

SEQ ID NO: 1103 - protein, 120 aa, Artificial Sequence
  Description of Artificial Sequence: Synthetic heavy chain variable region amino acid sequence
QVQLVQSGAEVKKPGESLKISCKASGYSFTSHYWIGWVRQMPGKGLEWMGFIFPGDSDTRYSPSLQGQVTISADKSTNTAYLQWNSLKASDTAMYYCARLEYLVSGFEYWGQGTLVTVSS

SEQ ID NO: 1104 - protein, 111 aa, Artificial Sequence
  Description of Artificial Sequence: Synthetic light chain variable region amino acid sequence
QPGLTQPHSVSESPGKTVTISCTRSSGSIASNYVHWYQQRPGSFPTTVIYEDNQRPSGVPDRFSGSIDSSSNSASLTISGLRTEDEADYYCQSYDSSNPVVFGGGTKVTVL

SEQ ID NO: 1105 - protein, 118 aa, Artificial Sequence
  Description of Artificial Sequence: Synthetic heavy chain variable region amino acid sequence
QVQLVQSGAEVKKPGESLKISCKGSGYSFTNNWVGWVRQMPGKGLEWMGIIFPGDSDTRYSPSFRGQVTISVDTSINTAFLQWNSLGASDTAMYYCAMTDYNYSFKSWGQGTLVTVSS

SEQ ID NO: 1106 - protein, 111 aa, Artificial Sequence
  Description of Artificial Sequence: Synthetic light chain variable region amino acid sequence
NFMLTQPHSVSESPGKTITISCTRSSGNIGNNYVQWYQQRPGSSFTTVIYEDYQRPSGVPDRFSGSIDSSSNSATLTISGLKTEDEADYYCQSYDSSNPYVFGTGTKVTVL

SEQ ID NO: 1107 - protein, 120 aa, Artificial Sequence
  Description of Artificial Sequence: Synthetic heavy chain variable region amino acid sequence
QVQLVQSGAEVKKPGASVKVSCKASGYTFTHYGISWVRQAPGQGLEWMAWISAYNGNTNYAQKLQDRVTVTTDTSTSTAYMELRSLRSDDTALYYCARDSMGGTTLFDYWGQGTLVTVSS

SEQ ID NO: 1108 - protein, 114 aa, Artificial Sequence
  Description of Artificial Sequence: Synthetic light chain variable region amino acid sequence
DIVLTQTPLSLPVTLGQPASISCRSSQSLVYSDGNTYLNWFQQRPGQSPRRLIYKVSNRDSGVPDRFTGSGSGTDFTLKISRVEAEDVGVYYCMQGTHWPPMYTFGQGTKLEIK

SEQ ID NO: 1109 - protein, 121 aa, Artificial Sequence
  Description of Artificial Sequence: Synthetic heavy chain variable region amino acid sequence
EVQLLESGGGLVKPGGSLRLSCAASGFIFRDYYMIWIRQAPGKGLEWVSYISSSSTYTNNADSVKGRFTISRDNAKNSLYLQMNSLRAEDTAVYYCARLFASRSDGAFDIWGQGTTVTVSS

SEQ ID NO: 1110 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPETAPKLLIYDNNNRPSGVPDRFSGSKSGTSASLAITGLQAEDEADYYCQSYDSSLSGYVFGTGTTVTVL

SEQ ID NO: 1111 - protein, 117 aa, Artificial Sequence
  Description of Artificial Sequence: Synthetic heavy chain variable region amino acid sequence
QVQLVQSGGGVVQPGRSLRLSCAASGFTVSSYAIHWVRQSAGKGLEWVAVEGRFTISRDNSKNTLYLQMNSLRAEDTAVYYCARLSEALVEPAAHTQYKYHYGLDVWGQGTTVTVSS

SEQ ID NO: 1112 - protein, 112 aa, Artificial Sequence
  Description of Artificial Sequence: Synthetic light chain variable region amino acid sequence
EIVLTQSPLSLPVTPGEPASISCKSSQSLLDSNGYNYLDWYLQKPGQSPQLLIYLVSNRASGVPDRFSGSGSGTDFTLKISRVEAEDVGIYYCMQALQTPWTFGQGTKVEIK

SEQ ID NO: 1113 - protein, 129 aa, Artificial Sequence
  Description of Artificial Sequence: Synthetic heavy chain variable region amino acid sequence
QVQLQQWGAGLLKPSETLSLTCGVYGESFSGHYWSWIRQPPGKGLEWMGEIHHSGTTNYNPSLKSRVTISVDTSKNQFSLKLNSVTAADTAVYYCARNPAEDILTGYSPPFHYYYMDVWGKGTTVTVSS

SEQ ID NO: 1114 - protein, 110 aa, Artificial Sequence
  Description of Artificial Sequence: Synthetic light chain variable region amino acid sequence
QSVLTQPPSVSGAPGQRVTISCTGSSSNIGAGYDVHWYQQIPGTAPKLLIHSNNNRPSGVPDRFSGSKSGTSASLAITGLQAEDEADYYCQSYDSSLSVVFGGGTKLTVL

SEQ ID NO: 1115 - protein, 125 aa, Artificial Sequence
  Description of Artificial Sequence: Synthetic heavy chain variable region amino acid sequence
QVQLVQSGGGLVKPGGSLRLSCTASGFTFSDYYMDWIRQAPGKGLEWVSSISSSSTYTKYADSVKGRFTISRDNAKNSLFLQMNSLRAEDTAVYYCVRNLGPYCSSTSCFVFDYWGQGTLVTVSS

SEQ ID NO: 1116 - protein, 111 aa, Artificial Sequence
  Description of Artificial Sequence: Synthetic light chain variable region amino acid sequence
QSVLTQPPSVSGAPGQRVSISCTGSSSNIGAGYEVHWYKQVPGTAPRLLMYDNTNRPSGVPDRVSGSKSGTSASLAITGLQAEDEADYYCQSYDNSLNKSVFGGGTKVTVL

SEQ ID NO: 1117 - protein, 122 aa, Artificial Sequence
  Description of Artificial Sequence: Synthetic heavy chain variable region amino acid sequence
EVQLVESGGGLVKPGGSLRLSCAASGFTFSDYYMNWIRQAPGKGLEWVSDISPSSSYTNYADSVKGRFTISRDNAKNSLYLQMNSLRAEDTAMYYCARRGSCTGGVCSFDYWGQGTLVTVSS

SEQ ID NO: 1118 - protein, 111 aa, Artificial Sequence
  Description of Artificial Sequence: Synthetic light chain variable region amino acid sequence
QPGLTQPPSVSGAPGQRVTISCTGSSSNIGAGYDVNWYQQLPGTAPKLLIYDNSNRPSGVPDRFSGSKSGTSASLAITGLQAEDEADFYCQSYDSSLSGFVFGTGTKVTVL

SEQ ID NO: 1119 - protein, 124 aa, Artificial Sequence
  Description of Artificial Sequence: Synthetic heavy chain variable region amino acid sequence
EVQLLESGGGLVKPGGSLRLSCAASGFTFRDYYMSWIRQAPGKGLEWVSYISSSSSYTEYADSVKGRFTISRDNAKKSLYLQMNSLRTEDTAVYYCARVITQAGTGTTYYMDVWGKGTTVTVSS

SEQ ID NO: 1120 - protein, 110 aa, Artificial Sequence
  Description of Artificial Sequence: Synthetic light chain variable region amino acid sequence
QSVLTQPPSVSGAPGQRVTISCTGSSSNIGTGYDVHWYQQLPGTAPKLLIYANNNRPSGVPDRFSGSKSGTSASLAITGLQAEDEADYYCQSYDSSLSLVFGGGTKLTVL

SEQ ID NO: 1121 - protein, 132 aa, Artificial Sequence
  Description of Artificial Sequence: Synthetic heavy chain variable region amino acid sequence
QITLKESGPTLVKPTQTLTLTCTFSGFSLTTTGVGVGWIRQPPGKALEWLALIYWDDDKRYSPSLKNRITITKDTSKKQVVLTMTNMDPADTATYYCAHISTVVTYDSSGSYYVLINWFDPWGQGTLVTVSS

SEQ ID NO: 1122 - protein, 112 aa, Artificial Sequence
  Description of Artificial Sequence: Synthetic light chain variable region amino acid sequence
EIVMTQSPLSLPVTPGEPASISCRSSHSLLHSNGYNYLDWYLQKPGQSPQLLIYLGSNRASGVPDRFSGSGSGTDFTLKISRVEAEDVGVYYCMQALQTPLTFGQGTKVDIK

SEQ ID NO: 1123 - protein, 117 aa, Artificial Sequence
  Description of Artificial Sequence: Synthetic heavy chain variable region amino acid sequence
QVQLQQWGAGLLKPSETLSLICDVYGGSFSDYYWSWIRQSPGKGLEWIGEINHSGSTSFHPSLKSRISISIDTSNNQFSLNLSSMTAADTAVYYCARGTLRGYFDYWGQGTLVTVSS

SEQ ID NO: 1124 - protein, 107 aa, Artificial Sequence
  Description of Artificial Sequence: Synthetic light chain variable region amino acid sequence
EIVLTQSPSTLSAFVGDRVTITCRASQSISRWLAWYQQKPGKAPNLLISEASSLESGVPSRFSGSGSGTEFTLTISSLQPDDLGTYYCQQYNGYLWTFGQGTKVEIK

SEQ ID NO: 1125 - protein, 127 aa, Artificial Sequence
  Description of Artificial Sequence: Synthetic heavy chain variable region amino acid sequence
QVQLVQSGAEVKKPGASVQVSCKASGYTFTGDYMHWVRQAPGQGLEWMGRINPNSGGTNYAQKFQGRVTMTRDTSISTAYMELSRLRSDDTAVYYCARAAAEYSSSSPTSYYYMDVWGKGTTVTVSS

SEQ ID NO: 1126 - protein, 108 aa, Artificial Sequence
  Description of Artificial Sequence: Synthetic light chain variable region amino acid sequence
EIQMTQSPSSLSASVGDRVTITCRASQNIYSFLNWYQQKPGKAPKLLIYAASSLQSGVPSRFSGSGSATDFTLTISSLQPEDFATYYCQQSYSPPQITFGQGTKVDIK

SEQ ID NO: 1127 - protein, 117 aa, Artificial Sequence
  Description of Artificial Sequence: Synthetic heavy chain variable region amino acid sequence
EVQLVESGGGVVQPGRSLRLSCAASGFPFSSYAMHWVRQAPGKGLEWVAVIWFEGNEKYFADSVEGRFTISRDNSKNTLYLQMNSLRAEDTARYYCARFYFGAFDIWGQGTLVTVSS

SEQ ID NO: 1128 - protein, 112 aa, Artificial Sequence
  Description of Artificial Sequence: Synthetic light chain variable region amino acid sequence
DIVMTQSPLSLPVTPGEPASISCRSSQSLLHSNGYNSLDWYLQKPGQSPQLLIYLASNRASGVPDRFSGSGSGTDFTLKISRVEAEDVGVYYCMQALQTPYTFGQGTKVEIK

SEQ ID NO: 1129 - protein, 119 aa, Artificial Sequence
  Description of Artificial Sequence: Synthetic heavy chain variable region amino acid sequence
QVQLVQSRAEVKKPGESLKISCKGSLHSFSNNWIGWVRQMPGKGLEWMGIIFPDDSDTRYSPSFQGQVTISADKSISTAYLQWSSLKASDTAIYYCGTVVTLIQGVADWGQGTLVTVSS

SEQ ID NO: 1130 - protein, 111 aa, Artificial Sequence
  Description of Artificial Sequence: Synthetic light chain variable region amino acid sequence
QPVLTQPHSVSESPGKTVTISCTRSSGSIDSSYVQWYQQRPGSSPTTVIYEDNLRPSGVPDRFSGSIDSSSNSASLTISGLKTEDEAEYYCQSYDSSNPVVFGGGTKLTVL

SEQ ID NO: 1131 - protein, 125 aa, Artificial Sequence
  Description of Artificial Sequence: Synthetic heavy chain variable region amino acid sequence
QVTLKESGGGLIQPGGSLRLSCAVSGFTVSSKYMSWVRQAPGKGLEWVSVIYGGGSTYYTDSVKGRFTISRDNSNNTLYLQMNSLRAEDTAIYYCAREARSYNYDYVGNDAFDIWGQGTTVTVSS

SEQ ID NO: 1132 - protein, 114 aa, Artificial Sequence
  Description of Artificial Sequence: Synthetic light chain variable region amino acid sequence
DIVLTQTPDSLAVSLGERATINCKSSQSVLNNFNNKNYLAWYQQKPGQPPKLLIYWASTRESGVPDRFSGSGSGTDFTLTITSLQAEDVAIYYCQQYYRTPPYTFGQGTKVDIK

SEQ ID NO: 1133 - protein, 119 aa, Artificial Sequence
  Description of Artificial Sequence: Synthetic heavy chain variable region amino acid sequence
QVQLVESGGGLVKPGGSLRLSCAASGFSFSAYYMSWIRQAPGKGLEWISNISGGSSYANYADSVEGRFTISRDNAKNSLYLQMNSLRAEDTAVYYCAREFQTYYYMDVWGKGTTVTVSS

SEQ ID NO: 1134 - protein, 111 aa, Artificial Sequence
  Description of Artificial Sequence: Synthetic light chain variable region amino acid sequence
QPVLTQPPSVSGAPGQRVTISCTGSSSNIGAGYEVHWYQQLPGTAPKLLIYGNNNRPSGVPDRFSGSKSGTSASLAITGLQAEDEADYYCQSYDSSLSGSVFGGGTKLTVL

SEQ ID NO: 1135 - protein, 119 aa, Artificial Sequence
  Description of Artificial Sequence: Synthetic heavy chain variable region amino acid sequence
EVQLLESGPGLVKPSETLSLTCIVSGGSISSYNWNWIRQPPGKGLEWIGYIYNSGSTNYNPSLKSRVTISVDTSKNQFSLKLSSVTAADTAVYYCARYFDYGSGGFDYWGQGTLVTVSS

SEQ ID NO: 1136 - protein, 107 aa, Artificial Sequence
  Description of Artificial Sequence: Synthetic light chain variable region amino acid sequence
ETTLTQSPGTLSLSPGERATLSCRASQSVTSTYLAWYQQKPGQAPRLLIYGASSRATGIPDRFSGSGSGTDFTLTISRLEPEDFAVYYCQQFDSSLTFGGGTKVEIK

SEQ ID NO: 1137 - protein, 120 aa, Artificial Sequence
  Description of Artificial Sequence: Synthetic heavy chain variable region amino acid sequence
QVQLVQSGAEVKKPGASLQVSCKASGYTFTDSYFHWVRQAPGQGLEWMGRISPHSGGTNYAQKFQGRVTMTRDTSISTAYLELSRLRSDDTAVYYCATEGPRGPFRFDPWGQGTLVTVSS

SEQ ID NO: 1138 - protein, 110 aa, Artificial Sequence
  Description of Artificial Sequence: Synthetic light chain variable region amino acid sequence
NFMLTQPHSVSESPGKTVTISCTRSSGSIASNYVQWYQQRPGSSPTTVIYEDNQRPSGVPDRFSGSIDSSSNSASLTISGLMTEDEADYYCQSYDSSNWVFGGGTKLTVL

SEQ ID NO: 1139 - protein, 125 aa, Artificial Sequence
  Description of Artificial Sequence: Synthetic heavy chain variable region amino acid sequence
QVQLVQSGGGVVQPGRSLRLSCAASGFTFSSYSMHWVRQAPGKGLEWMAVCWYDGSNIYYADSVKGRFTISRDNSKNTVYLQMNSLRAEDTAVYYCARDDRYCSGGTCLSAFDIWGQGTMVTVSS

SEQ ID NO: 1140 - protein, 107 aa, Artificial Sequence
  Description of Artificial Sequence: Synthetic light chain variable region amino acid sequence
ETTLTQSPSSLSASVGDRVTITCRASQSISSYLNWYQQKPGRAPKLLIYTTSSLQSGVSSRFSGSGSGTDFTLTINSLQPEDFATYYCQQSYSTPNTFGQGTKVEIK

SEQ ID NO: 1141 - protein, 118 aa, Artificial Sequence
  Description of Artificial Sequence: Synthetic heavy chain variable region amino acid sequence
QVQLVQSGAEVKKPGESLKISCQVSRDTSTTYWIGWVRQMPGKGLEWMGIIFPGDSDTRYSPSFQGQVTISADKSIMTAYLQLTSLKASDTAMYYCATQALRGAFDIWGQGTMVTVSS

SEQ ID NO: 1142 - protein, 107 aa, Artificial Sequence
  Description of Artificial Sequence: Synthetic light chain variable region amino acid sequence
DIRLTQSPSSLSASVGDRVTITCQASQDISNYLNWYQQKPGKAPKLLIYDASYLETGVPSRFSGSGSGTDFTFTISSLQPEDFATYYCQQYDDLLFTFGPGTKLEIK

SEQ ID NO: 1143 - protein, 122 aa, Artificial Sequence
  Description of Artificial Sequence: Synthetic heavy chain variable region amino acid sequence
QVQLQQWGAGLLKPSETLSLTCAVSGESLTGYFWSWIRQPPGKGLEWIGEVSHSGSTNYNPSLKSRVTMSVDTSKTQFSLKLNSVTAADTAVYYCARGYDYWSGTARYFDYWGQGILVTVSS

SEQ ID NO: 1144 - protein, 111 aa, Artificial Sequence
  Description of Artificial Sequence: Synthetic light chain variable region amino acid sequence
QPVLTQPASVSGSPGQSITISCTGTSSDVGGYNYVSWYQQHPGKAPKLMIYDVSNRPSGVSSRFSGSKSGNTASLTISGLQAEDEGDYYCSSYRSSTTSRVFGGGTKVTVL

SEQ ID NO: 1145 - protein, 123 aa, Artificial Sequence
  Description of Artificial Sequence: Synthetic heavy chain variable region amino acid sequence
EVQLVESGGGLVKPGGSLRLSCAASGFTFSDYYMTWIRQAPGKGLEWVSNISGGSSYTNYADSVKGRFTISRDNAKNSVYLQMNSLRAEDTAVYYCARVGCSGGVCNFFLDYWGQGTLVTVSS

SEQ ID NO: 1146 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYDNTNRPSGVPDRFSGSKSGTSASLAITGLQAEDEADYYCQSYDSSLSGYVFGTGTKVTVL

SEQ ID NO: 1147 - protein, 118 aa, Artificial Sequence
  Description of Artificial Sequence: Synthetic heavy chain variable region amino acid sequence
EVQLVQSGAEVKKPGESLKISCMGSGYNFPNYWIGWVRQMSGKGLEWMGIIYPDDSDTTYSPSFQGQVIFSADKSISTAYLQWSSLKASDTAMYFCVRLDKTTQIDFWGQGTLVTVSS

SEQ ID NO: 1148 - protein, 107 aa, Artificial Sequence
  Description of Artificial Sequence: Synthetic light chain variable region amino acid sequence
EIVLTQSPSSLSASVGDRVTITCQASQDISNYLNWYQQKPGKAPKLLIYDVSNLETGVPSRFSGSGSGTDFTFTISSLQPEDIATYYCQQHDNLPLTFGQGTRLEIK

SEQ ID NO: 1149 - protein, 127 aa, Artificial Sequence
  Description of Artificial Sequence: Synthetic heavy chain variable region amino acid sequence
EVQLVQSGPGLVKPSETLSLTCTVSGDSISSSDYSYYWGWIRQPPGKGLEWIASLSYSGKTYSQSSLKSRVIISVDTSKKQFSLKLSSVTAADTAVYYCAVTRCYVCTSEGDSFDMWGQGTMVTVSS

SEQ ID NO: 1150 - protein, 108 aa, Artificial Sequence
  Description of Artificial Sequence: Synthetic light chain variable region amino acid sequence
DIVLTQTPGTLSLSPGERATLSCRASQSISGNYLAWYQHKPGQAPRLLIYGASTRATGIPDRFSGSGSGTDFPLTISRLEPEDFAVYYCQQYATSPYTFGQGTKVDIK

SEQ ID NO: 1151 - protein, 122 aa, Artificial Sequence
  Description of Artificial Sequence: Synthetic heavy chain variable region amino acid sequence
EVQLVESGGGLVQSGGSLRLSCAASGFTFSSYEMNWVRQAPGKGLEWVSYTTNNGRTIYYADSVKGRFTISRDNAKNSLFLQMNGLRAEDTAVYYCARGIQFSRVDYAMDVWGQGTTVTVSS

SEQ ID NO: 1152 - protein, 111 aa, Artificial Sequence
  Description of Artificial Sequence: Synthetic light chain variable region amino acid sequence
SYELTQPPSVSGTPGQRITISCSGSSSNIASNTVNWYQHLPGTAPKLLIYSDNQRPSGVPDRFSGSKSGTSASLAISGLQSEDEADYYCAIWDDSLNASYVFGTGTKLTVL

SEQ ID NO: 1153 - protein, 119 aa, Artificial Sequence
  Description of Artificial Sequence: Synthetic heavy chain variable region amino acid sequence
EVQLVESGGGLVQPGGSLRISCAASGLTFSSYAMSWVRQAPGQGLEWVSSVSGSGVSTYYADSVKGRFTISRDNSKNTLYLQMNSLRAEDTAVYYCAKEDYYHFYMDVWGNGTTVTVSS

SEQ ID NO: 1154 - protein, 108 aa, Artificial Sequence
  Description of Artificial Sequence: Synthetic light chain variable region amino acid sequence
ETTLTQSPATLSVSPGERATLSCRASQSVSSNLAWYQQKPGQAPRLLIYGASTRAAGIPARFSGSGSGTEFTLTISSLQSEDFAVYYCQQHDNWPSYTFGQGTKVEIK

SEQ ID NO: 1155 - protein, 131 aa, Artificial Sequence
  Description of Artificial Sequence: Synthetic heavy chain variable region amino acid sequence
QVQLVQSGAEVKSPGSSATVSCKASGGTFGSYGISWVRQAPGQGLEWIGAIMPMFGTTNYAQKFQGRVTMTADESTSTVYMDVSSLRPDDTAVYYCVRDVFYDILTGYYDADYYHHYMDVWGKGTTVTVSS

SEQ ID NO: 1156 - protein, 112 aa, Artificial Sequence
  Description of Artificial Sequence: Synthetic light chain variable region amino acid sequence
DIVMTQSPLSLPVTLGQPASISCRSGQSLVHSDGNTYLNWFQQRPGQSPRRLIYKVSNRGSGVPDRFSGSGSGTDFTLKISRVEAEDVGVYFCMQGTHWPRTFGQGTKVDIK

SEQ ID NO: 1157 - protein, 129 aa, Artificial Sequence
  Description of Artificial Sequence: Synthetic heavy chain variable region amino acid sequence
QVQLVESGAEVKKPGSSVKVSCKASEGTFSSYGISWVRQAPGQGPEWMGEINPMFGTAKYAQKFQGRVTITVDESTSTADMELSSLTSEDTAVYYCAREFLGQCSETNCPTPSRHLDYWGQGTLVTVSS

SEQ ID NO: 1158 - protein, 106 aa, Artificial Sequence
  Description of Artificial Sequence: Synthetic light chain variable region amino acid sequence
EIVMTQSPSSLSASVGDRVTITCRASRTISSYLNWYQQKPGKAPKLLIYATSNLQSGVPSRFSGSGSGADFTLTISSLQPEDFATYYCQQTYSTPGFGPGTKVDIK

SEQ ID NO: 1159 - protein, 123 aa, Artificial Sequence
  Description of Artificial Sequence: Synthetic heavy chain variable region amino acid sequence
QVQLVQSGGGLVQRGGSLRLSCAASGFSFRSYAMSWVRQAPGKGLEWVSSISDSGDNTFYADSVKGRFSISRDNSRDTLYLQMNSLRAEDTAVYYCARGGYCSGGNCFPFDYWGQGTLVTVSS

SEQ ID NO: 1160 - protein, 108 aa, Artificial Sequence
  Description of Artificial Sequence: Synthetic light chain variable region amino acid sequence
SYELMQLPSVSVSPGQTARITCSGDALPKQYGYWYQQKPGQAPVLVIYKDSERPSGIPERFSGSSSGTTVTLTISGVQAEDEADYYCQSADSGGTYVMFGGGTKLTVL

SEQ ID NO: 1161 - protein, 125 aa, Artificial Sequence
  Description of Artificial Sequence: Synthetic heavy chain variable region amino acid sequence
QVQLVESGGRLVKPGGSLRLSCAASGFTFSDFYMSWIRQAPGKGLEWVSYISSSGDDPNYADSVKGRFTISRDNSKNSLYLQMNSLRAEDTAVYYCARDEVGWNNLDYYFGMDVWGQGTTVTVSS

SEQ ID NO: 1162 - protein, 112 aa, Artificial Sequence
  Description of Artificial Sequence: Synthetic light chain variable region amino acid sequence
DIVMTQSPLSLPVTLGQPASISCRSSQSLVHSDGNTYLSWFHQRPGQSPRRLIYKVSNRDSGVPNRFSGGGSGTDFTLKISRVEAEDVGFFYCMQGTHWQKTFGQGTKVEIK

SEQ ID NO: 1163 - protein, 129 aa, Artificial Sequence
  Description of Artificial Sequence: Synthetic heavy chain variable region amino acid sequence
QVQLVQSGAEVKKPGSSVKVSCKASGGTFSSYGISWVRQAPGQGLEWMGGIIPMFGAANYAQKFQGRVTITAETSTSTAFMELSSLRSDDTAVYYCARIRWVPNWGGTATSFYNGMDVWGQGTTVTVSS

SEQ ID NO: 1164 - protein, 108 aa, Artificial Sequence
  Description of Artificial Sequence: Synthetic light chain variable region amino acid sequence
EIVMTQSPGTLSLSPGERATLSCRASQSVSSSYLAWYQQKPGQAPRLLIYGASSRATGIPDRFSGSGSGTDFTLTISRLEPEDFAVYYCQHYGSSLFTFGPGTKVDIK

SEQ ID NO: 1165 - protein, 117 aa, Artificial Sequence
  Description of Artificial Sequence: Synthetic heavy chain variable region amino acid sequence
QVQLVQSGAEVKKPGASVKVYCKASGYTFTSHYIHWVRQAPGQGLEWMGRMNPSGGSPMYAQKFQERVTMTRDTSTSTAYMELRSLRSEDTAVYYCAMAKFYSFDYWGQGTLVTVSS

SEQ ID NO: 1166 - protein, 110 aa, Artificial Sequence
  Description of Artificial Sequence: Synthetic light chain variable region amino acid sequence
QSVLTQPHSVSESPGKTVTISCTRSSGSIASYFVHWYQQRPGSAPTIVIYEDNQRPSGVPDRFSGSIDSSSNSASLTISGLKTEDEADYYCQSYDSSNWVFGGGTKLTVL

SEQ ID NO: 1167 - protein, 124 aa, Artificial Sequence
  Description of Artificial Sequence: Synthetic heavy chain variable region amino acid sequence
EVQLVESGGGLVKPGGSLRLSCAASGFTFSNTWMSWVRQAPGKGLEWVGHIKSKTDGGTTDYAAPVKGRFTISRDDSKSILNLHLNSLKTEDSAVYYCAALPPISGWYYTPGFWGQGTLVTVSS

SEQ ID NO: 1168 - protein, 107 aa, Artificial Sequence
  Description of Artificial Sequence: Synthetic light chain variable region amino acid sequence
SYELTQPPSMSVSPGQTARITCFGDAVPKKYVYWYQQKSGQAPVMVIYDDRRRPSGIPERFSGSSSGARATLTISGAQVEDEADYYCYSTDGSGNPSFGGGTKLTVL

SEQ ID NO: 1169 - protein, 120 aa, Artificial Sequence
  Description of Artificial Sequence: Synthetic heavy chain variable region amino acid sequence
EVQLVQSGAEVKKPGESLTISCKDSGYSFTSYWIGWVRQVPGKGLEWMGIVYPGDSRYSPSFQGHVTMSADKSINTAYLQWSTLKASDTAMYYCAKVVTYGSAIRWFESWGQGTLVTVSS

SEQ ID NO: 1170 - protein, 110 aa, Artificial Sequence
  Description of Artificial Sequence: Synthetic light chain variable region amino acid sequence
QSVLTQPPSVSAAPGQKVSISCSGSSSNIGNNFVSWYQQVPGTAPKLLIIDNNKRPSGIPDRFSGSKSGTSATLGITGLQTGDEADYYCGTWDSRLSAEVFGGGTKLTVL

SEQ ID NO: 1171 - protein, 130 aa, Artificial Sequence
  Description of Artificial Sequence: Synthetic heavy chain variable region amino acid sequence
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARDLPQVDYFDGASFYFFDFWGQGTLVTVSS

SEQ ID NO: 1172 - protein, 108 aa, Artificial Sequence
  Description of Artificial Sequence: Synthetic light chain variable region amino acid sequence
QPVLTQPPSVSVAPGQTASITCGGNIIGNKGVHWYQQKPGRAPVLVVYDDSDRPSGIPERFSGSNSGNTATLTISRVEAADEADYYCQVWDTGSHPVVFGGGTKVTVL

SEQ ID NO: 1173 - protein, 126 aa, Artificial Sequence
  Description of Artificial Sequence: Synthetic heavy chain variable region amino acid sequence
QVQLVQSGPGLVKPSGTLSLTCAVSGGSISTTHWWSWVRQPPGKGLEWIGEIYHSGSTNYNPSLKSRVTISVDKSRSQFSLKLTSVTAADTAVYYCARGDPLCSGGICYSGYFDYWGQGTLVTVSS

SEQ ID NO: 1174 - protein, 106 aa, Artificial Sequence
  Description of Artificial Sequence: Synthetic light chain variable region amino acid sequence
SYVLTQPPSVSVSPGQTATITCSGDKLGDQYACWYQQKSGQSPVLVIYRDNKRPSGIPERFSGSNSGNTATLTISETQAMDEADYYCQAWGSSSVVFGGGTKVTVL

SEQ ID NO: 1175 - protein, 120 aa, Artificial Sequence
  Description of Artificial Sequence: Synthetic heavy chain variable region amino acid sequence
EVQLVESGGGLVKPGGSLRLSCVASGFGFTSYSMNWVRQAPGKGLEWVSSISASSTYIHYADSVKGRFTISRDNARNSLYLQMISLRADDTAVYYCSRDGPTYGSGVHVWGQGTMVTVSS

SEQ ID NO: 1176 - protein, 112 aa, Artificial Sequence
  Description of Artificial Sequence: Synthetic light chain variable region amino acid sequence
QSALIQPVSVSGSPGQSITISCTGTRSDVGGYNYVSWYQQHPGKAPKLMIYEVRNRPSGVSDRFSGSKSGNTASLTISGLQAEDEGDYYCSSYTSSDTLFYVFGSGTKLTVL

SEQ ID NO: 1177 - protein, 124 aa, Artificial Sequence
  Description of Artificial Sequence: Synthetic heavy chain variable region amino acid sequence
EVQLVESGGGVVQPGQSLRLSCAASGFTFSSFAMHWVRQAPGKGLEWVAVISYDGSNKYYADSVKGRFTISRDNSKNTLSLQVNSLRAEDTAVYYCARVSAEGSMGRFSDFNYWGLGTLVTVSS

SEQ ID NO: 1178 - protein, 110 aa, Artificial Sequence
  Description of Artificial Sequence: Synthetic light chain variable region amino acid sequence
QSALTQPASVSGSPGQSITISCTGTSSDVGSYNLVSWYQQHPGKAPKLMIYEVRKRPSGVSNRFSGSKSGNTASLTISGLQAEDEADYYCCSYAGSDTYVFGTGTKLTVL

SEQ ID NO: 1179 - protein, 128 aa, Artificial Sequence
  Description of Artificial Sequence: Synthetic heavy chain variable region amino acid sequence
QVQLQESGPGLVKPSQTLSLTCAISGDSVSSNNAAWNWIRQSPSRGLEWLGRTYYRSKWYNDYAVSVKSRITINPDTSKNQLSLQLNSVTPEDTAVYYCARAGVRQWLVRGMDAFDIWGQGTMVTVSS

SEQ ID NO: 1180 - protein, 113 aa, Artificial Sequence
  Description of Artificial Sequence: Synthetic light chain variable region amino acid sequence
DIRLTQSPDSLAVSLGERATVNCKSSQSVLYSSNNKNYLAWYQQKPGQPPKLLIYWASTRESGVPDRFSGSGSGTDFTLTISSLQAEDVAVYYCQQYYNTPHTFGQGTKVEIK

SEQ ID NO: 1181 - protein, 124 aa, Artificial Sequence
  Description of Artificial Sequence: Synthetic heavy chain variable region amino acid sequence
EVQLLESGGDLVRPGGSLRLSCTASGFSFSSSEMNWVRQAPGKGLEWVASINSGGDDIYYADSVKGRFTISRDNAKNSLSLQMDSLRAEDTALYYCARSRSGYSSGWSRFFGNWGQGTLVTVSS

SEQ ID NO: 1182 - protein, 108 aa, Artificial Sequence
  Description of Artificial Sequence: Synthetic light chain variable region amino acid sequence
QSALTQPRSVSGSPGQSVTISCTGTISDIGAYNYVSWYQQHPGKAPKVMIYDVSKRPSGVPDRFSGSKSGFTASLTISGLQAEDEADYYCCSYAGRWVFGGGTKLTVL

SEQ ID NO: 1183 - protein, 121 aa, Artificial Sequence
  Description of Artificial Sequence: Synthetic heavy chain variable region amino acid sequence
EVQLVESGGGLVKPGGSLRLSCAASGFSFSSYAMNWVRQAPGKGLQWVSSISAGSSYIDYADSVKGRFTISRDNAENSLFLQMNSLRVEDTAVYYCARVGSYTHGYEFDYWGQGTLVTVSS

SEQ ID NO: 1184 - protein, 110 aa, Artificial Sequence
  Description of Artificial Sequence: Synthetic light chain variable region amino acid sequence
QPVLTQPPSVSGAPGQRVTISCTGSNSNIGAGYDVHWYQQLPGTAPKLLIYASTIRPSGVPDRFSGSKSGTSASLAITGLQAEDEADYYCQSYDRNLSVVFGGGTKVTVL

SEQ ID NO: 1185 - protein, 134 aa, Artificial Sequence
  Description of Artificial Sequence: Synthetic heavy chain variable region amino acid sequence
EVQLVESGGGLVKPGGSLRLSCAASGFMFSTYSMNWVRQAPGKGLEWVSFITGSSSDKYYAHSVKGRFTISRDNAKRTLYLQLNSLRAEDTAVYYCARFRGLYCDGDCSSRGNTYYNYYGMDVWGQGTTVTVSS

SEQ ID NO: 1186 - protein, 112 aa, Artificial Sequence
  Description of Artificial Sequence: Synthetic light chain variable region amino acid sequence
EIVMTQSPLSLSVIPGEPASISCRSSKSLLHSNGYTYLDWYLQKPGQSPQLLIHLGSNRASGVPDRFSGSGSGTDFTLKISRVEAEDVGVFYCMQALQAPPTFGPGTKVEIK

SEQ ID NO: 1187 - protein, 127 aa, Artificial Sequence
  Description of Artificial Sequence: Synthetic heavy chain variable region amino acid sequence
EVQLVESGGGLVQPGRSLRLSCRASGFTFRNYAMSWVRQAPGKGLEWVGFIRGKGYGGTTEYAASVKGRFTISSDDSRSIAYLQMNSLKTEDTAVYYCTRVREDGVIAVAEYYFDYWGQGTLVTVSS

SEQ ID NO: 1188 - protein, 108 aa, Artificial Sequence
  Description of Artificial Sequence: Synthetic light chain variable region amino acid sequence
GIQMTQSPGTLSLSPGERATLSCRASQSVSSSYLAWYQQKPGQAPRLLIHGASSRATGIPDRFSGSGSGTDFTLTISRLEPEDFAVYHCQQYGSSPWTFGQGTKVEIK

SEQ ID NO: 1189 - protein, 125 aa, Artificial Sequence
  Description of Artificial Sequence: Synthetic heavy chain variable region amino acid sequence
QVQLQESGPGLVKPSGTLSLTCAVSGGSITGRNWWSWVRQPPGKELERIGEIYHGGSTEYNPSLKGRVTISVDKSKNQFSLRLNSVTAADTAVYYCARVAHYDSNGYYIGYFDLWGRGTLVTVSS

SEQ ID NO: 1190 - protein, 107 aa, Artificial Sequence
  Description of Artificial Sequence: Synthetic light chain variable region amino acid sequence
EIVLTQSPPSLSASVGDRVTITCRASQSISIYLNWYQQKPGKAPKLLIFAASSLQSGVPLRFSGSGSGTDFTLTISSLQPEDFATYYCHQSYSAPWTFGQGTKVDIK

SEQ ID NO: 1191 - protein, 126 aa, Artificial Sequence
  Description of Artificial Sequence: Synthetic heavy chain variable region amino acid sequence
EVQLVESGPALVKPTQTLTLTCTFSGFSLSTKRMGVSWIRQPPGKALEWLARIDWDDDKFYSTSLKTRLTISKDTSKNQVVLTLANMDPVDTATYFCARTTVYASGGYYLYYLDYWGQGTLVTVSS

SEQ ID NO: 1192 - protein, 107 aa, Artificial Sequence
  Description of Artificial Sequence: Synthetic light chain variable region amino acid sequence
DIVMTQTPSSLSASVGDRVTLTCRASQRIASYVNWYHQKPGKAPNLLIYAASNLQSGVPSRFSGSGSGTDFTLTISSLQPEDFATYYCQQSYSTPLTFGQGTKLEIK

SEQ ID NO: 1193 - protein, 123 aa, Artificial Sequence
  Description of Artificial Sequence: Synthetic heavy chain variable region amino acid sequence
QVQLVQSGAEVKKAGETLKISCRGPAHTFTSFWIGWVRQTPGKGLEWMGNIYPGDTDTTYSPSFRGQVTISADKSISTAYLQWNSLKASDTAIYYCATRVRHGYSSSGSFESWGQGTMVTVSS

SEQ ID NO: 1194 - protein, 111 aa, Artificial Sequence
  Description of Artificial Sequence: Synthetic light chain variable region amino acid sequence
QSVVTQPPSVSGAPGQRITISCTGSNSNTGAGYDVHWYQQLPGAAPKLLIFANNNRPSGVPDRFSGSKSGTSASLAITGLQAEDEADYYCQSYDNSLSAYVFGTGTKLTVL

SEQ ID NO: 1195 - protein, 124 aa, Artificial Sequence
  Description of Artificial Sequence: Synthetic heavy chain variable region amino acid sequence
QVQLVESGPGLVKPSETLALTCTVSGGSLSTYYWSWIRQPPGKGLEWIGYIYYSGTTYYNPSLKSRVTISEDRSKNQFSLKLTSVTAADTAVYYCARHGPKTEFWSAQYYLELWGRGTLVTVSS

SEQ ID NO: 1196 - protein, 108 aa, Artificial Sequence
  Description of Artificial Sequence: Synthetic light chain variable region amino acid sequence
EIVLTQSPGTLSLSPGERATLSCRASQSVSSDYLAWYQQKPGQAPSLLIYGVSTRATGIPDRISGSGSGTDFTLTISRLEPEDFAVYYCHQYGTSPWTFGQGTKVEIK

SEQ ID NO: 1197 - protein, 125 aa, Artificial Sequence
  Description of Artificial Sequence: Synthetic heavy chain variable region amino acid sequence
QVQLVQSGAEVKKPGASVKVSCKASGYSFTNHGIHWVRQAPGQRLEWMGWINVANGFTAYSQNLQGRVTFTRDTSASTAYLELTSLRSEDTAVYHCARDESYCSAGYCYLYFDYWGQGTTVTVSS

SEQ ID NO: 1198 - protein, 107 aa, Artificial Sequence
  Description of Artificial Sequence: Synthetic light chain variable region amino acid sequence
DIQVTQSPSSLSASVGDRVTITCRASQNIITYVNWYQQKPGKAPELLIFGASSVQSGVPSRFSGSGSGTDFTLTISSLRPDDFATYYCQQSYSNPRTFGGGTKVEIK

SEQ ID NO: 1199 - protein, 120 aa, Artificial Sequence
  Description of Artificial Sequence: Synthetic heavy chain variable region amino acid sequence
QVQLVQSGGGVVQPGRSLRLSCAASGFMFTIYSMHWVRQAPGKGLEWVAVISNDGVNKYYSDSVKGRFTISRDNSKNTLYLQMNNLRAEDTAVYYCASDIVVLVTATDYWGQGTLVTVSS

SEQ ID NO: 1200 - protein, 108 aa, Artificial Sequence
  Description of Artificial Sequence: Synthetic light chain variable region amino acid sequence
ETTLTQSPVTLSLSPGERATLSCRTSQSFSSPLLAWYQQKPGQAPRLLIYGASNRATGIPDRFSGSGSGTDFTLTISRLEPVDFAVYYCQQYGSSPYTFGQGTKLEIK

SEQ ID NO: 1201 - protein, 123 aa, Artificial Sequence
  Description of Artificial Sequence: Synthetic heavy chain variable region amino acid sequence
QVTLKESGPTLVKPTQTLTLTCTFSGFSLSTFGVAVGWIRQPPGKALEWLALIYWDDDKRYSPSLKSRLTITKDISKNQVVLTMTNMDPVDTATYYCAHRLRSLTARGVFDIWGQGTTVTVSS

SEQ ID NO: 1202 - protein, 107 aa, Artificial Sequence
  Description of Artificial Sequence: Synthetic light chain variable region amino acid sequence
DIRLTQSPSSLSASVGDRVTITCRASQSINNFLNWYQQRPGKAPTLLIYSASSLQSGVPSRFSGSGSGTDFTLTISSLQPEDFATYFCQQTDSFPWTFGQGTKVEIK

SEQ ID NO: 1203 - protein, 131 aa, Artificial Sequence
  Description of Artificial Sequence: Synthetic heavy chain variable region amino acid sequence
QVQLVQSGGGLVKPGGSLRLSCAASGFTFSNAWMSWVRQAPGKGLEWVGRIKSEVDGGTADYAANVKGRLTISRDDSKNMMYLQMNSLKTEDTAVYYCTTDPGVGWIFGEVKLFRTDPEYWGQGTLVTVSS

SEQ ID NO: 1204 - protein, 111 aa, Artificial Sequence
  Description of Artificial Sequence: Synthetic light chain variable region amino acid sequence
QSVLTQPPSVSAAPGQKVTISCSGSSSNIGNHYVSWYQQLPGTSPKLLIYDNNKRPSGIPDRFSGSKSGTSATLGITGLQPGDEADYYCGTWDSSLSAVRVFGGGTKVTVL

SEQ ID NO: 1205 - protein, 126 aa, Artificial Sequence
  Description of Artificial Sequence: Synthetic heavy chain variable region amino acid sequence
QVQLVQSGAEVKKPGSSVKVSCKASGGTFSYYAISWVRQAPGQGLEWMGGIIPILGTVKNAQKFQGRVTITADKITSIAYMELSSLRHEDTAVYYCARDYYDSSGYYYNGYGMDVWGQGTTVTVSS

SEQ ID NO: 1206 - protein, 112 aa, Artificial Sequence
  Description of Artificial Sequence: Synthetic light chain variable region amino acid sequence
QSVLIQPPSASGTPGQRVTISCSGSSSNIGSNYVYWYQQLPGTAPKLLIYRNDQRPSGVPDRFSGSKSGTSASLAISGLRSGDEADYYCAAWDDSLGGPIWVFGGGTKLTVL

SEQ ID NO: 1207 - protein, 126 aa, Artificial Sequence
  Description of Artificial Sequence: Synthetic heavy chain variable region amino acid sequence
QVQLVQSGAEVKKPGASVKVSCKASGYTFISYGISWVRQAPGQGPEWMGWISTHNGNTNYAQKLQGRVTMTTDTSTSTAYMELRSLRSDDTAVYYCARDERSIAVEVYLGSTFDIWGQGTMVTVSS

SEQ ID NO: 1208 - protein, 107 aa, Artificial Sequence
  Description of Artificial Sequence: Synthetic light chain variable region amino acid sequence
DIQVTQSPSSVSASVGDRVTITCRASQGISSWLAWYQQKPGKAPKLLIYAASTLQSGVPSRFSGSGSGTDFTLTISRLQPEDFATYYCQQANIFGVTFGPGTKVDIK

SEQ ID NO: 1209 - protein, 123 aa, Artificial Sequence
  Description of Artificial Sequence: Synthetic heavy chain variable region amino acid sequence
EVQLVESGGGLVQPGRSLRLSCAASGFTFDDYAMHWVRQAPGKGLEWVSSISWHSADIGYAASVEGRFTISRDNAKNSLFLQMNSLRPEDTALYYCAKEIVSTSWYSGYFQDWGQGTLVTVSS

SEQ ID NO: 1210 - protein, 110 aa, Artificial Sequence
  Description of Artificial Sequence: Synthetic light chain variable region amino acid sequence
QPVLTQPRSVSGSPGQSVTISCTGTSSDVGDYNYVSWYQQHPGKAPKLMIYDVSKRPSGVPDRFSGSKSGNTASLTISGLQGEDEADYYCCSYAGRHTFVFGTATKVTVL

SEQ ID NO: 1211 - protein, 128 aa, Artificial Sequence
  Description of Artificial Sequence: Synthetic heavy chain variable region amino acid sequence
EVQLVESGGGLVQPGGSLRLSCAASGFTFSSYAMSWVRQAAGKGLEWVSAISGSGDDTFYADSVKDRFIISRDSSKRKVYLQMNSLRVEDTAVYYCAKTDIMVTFGGVVVDAYYFDHWGQGTLVTVSS

SEQ ID NO: 1212 - protein, 109 aa, Artificial Sequence
  Description of Artificial Sequence: Synthetic light chain variable region amino acid sequence
ETTLTQSPGTLSLSPGERATLSCRASQFVFRSYLAWYQQRPGQPPRLLIYGASSRATGIPDRFSGRGSGTEFTLTISRLEPEDFAMYYCQHYDSSPPGTFGGGTKVEIK

SEQ ID NO: 1213 - protein, 122 aa, Artificial Sequence
  Description of Artificial Sequence: Synthetic heavy chain variable region amino acid sequence
EVQLVQSGAEVKKPGESLKISCKGSGYSFSSFWIGWVRQMPGKGLEWMGIIYPGDSDTRYSPSFQGQVTISADQSIRTAYLQWNSLKASDTGLYYCAKGGLGDVEMATIAVWGQGTLVTVSS

SEQ ID NO: 1214 - protein, 112 aa, Artificial Sequence
  Description of Artificial Sequence: Synthetic light chain variable region amino acid sequence
QSVLIQPASVSGSPGQSITIPCTGTSSDVGSYNLVSWYQHHPGKAPKLIISEGSKRPLGVSNRFSGSKSGNTASLTISGLQAEDEADYYCSSYVRSRTFNYVFGTGTKLTVL

SEQ ID NO: 1215 - protein, 126 aa, Artificial Sequence
  Description of Artificial Sequence: Synthetic heavy chain variable region amino acid sequence
QVQLQQWGAGLLKPSETLSLTCVVYGESFSDSGYYWTWIRQPPEKGLEWIGEINHGGSTSYNPSLKSRVTISVDTSENQFSLKVTSVTGADTAVYYCARLRLGCSGGSCYSRFDYWGQGTLVTVSS

SEQ ID NO: 1216 - protein, 107 aa, Artificial Sequence
  Description of Artificial Sequence: Synthetic light chain variable region amino acid sequence
DIQLTQSPSSLSASVGDRVTITCRASQSINSYLNWYQQKPGKAPVLLIHAASSLQGGVPSRFSGSGSGTDFTLTISSLQPEDFATYYCQQSYNTRWTFGHGTKVDIK

SEQ ID NO: 1217 - protein, 124 aa, Artificial Sequence
  Description of Artificial Sequence: Synthetic heavy chain variable region amino acid sequence
EVQLLESGGGVVQPGRSLRLSCAASGFSFSSYGIHWVRQAPGKGLECVALMSYDGSEKYYADSVKGRFTISRDNSKNTLYLHMNSLRREDTAVYYCAKGSHLRWSHLDYYFHLWGRGTLVTVSS

SEQ ID NO: 1218 - protein, 103 aa, Artificial Sequence
  Description of Artificial Sequence: Synthetic light chain variable region amino acid sequence
DIVMTQSPSTLSASVGDRVTITCRASQSLSTWLAWYQQKPGKAPKLLISDASNLESGVPSRFSGRGSGTEFTLTISGLQPDDFATYYCQQERTFGQGTKVDIK

SEQ ID NO: 1219 - protein, 124 aa, Artificial Sequence
  Description of Artificial Sequence: Synthetic heavy chain variable region amino acid sequence
QVQLQQSGPGLAKPSQTLSLTCTVSGGPISGVDYYWSWIRQPPGKGLEWIGYIYYSGSTYYNPSLKSRVTISVDTSKKQFSLKMSSVTAADTAVYYCARDVGATPYYYYGMDVWGQGTTVTVSS

SEQ ID NO: 1220 - protein, 110 aa, Artificial Sequence
  Description of Artificial Sequence: Synthetic light chain variable region amino acid sequence
DIVLTQSPDTLSLSPGERATLSCRASQSVRSNYLAWYQHKPGQAPRLLIYGASSRVAGIPDRFSGSGSGTDFTLTISRLEPEDFAVYYCQQYGSSPPSVTFGGGTKVEIK

SEQ ID NO: 1221 - protein, 125 aa, Artificial Sequence
  Description of Artificial Sequence: Synthetic heavy chain variable region amino acid sequence
EVQLLESGGGLVQPGGSLRLSCAASGFTFSAYEMNWVRQAPGKGLEWVSYISSSGSNKHYADSVKGRFTISRDNAKNSLHLHMNSLRAEDTALYYCTRPHQEEWELLPNDAFDLWGQGTMVTVSS

SEQ ID NO: 1222 - protein, 111 aa, Artificial Sequence
  Description of Artificial Sequence: Synthetic light chain variable region amino acid sequence
QSALTQPPSASGSPGQSVTISCTGTSTDVGAYTYVSWYQQHPGKAPKLIIYEVYKRPSGVPNRFFGSKSGNTASLTVSGLQAEDEADYYCSSYGGSNNFGLFGGGTKLIVL

SEQ ID NO: 1223 - protein, 117 aa, Artificial Sequence
  Description of Artificial Sequence: Synthetic heavy chain variable region amino acid sequence
EVQLVESGVEVKKPGESLKISCRGSGYTFYNYWIAWVRQKPGKGLEYMGTIYLDDSETIYSPSFQGEVTISADKSINTAYLQWNSLKASDTANYYCARQMDFYFDVWGRGTLVTVSS

SEQ ID NO: 1224 - protein, 107 aa, Artificial Sequence
  Description of Artificial Sequence: Synthetic light chain variable region amino acid sequence
SYELMQPPSVSVSPGQTARITCSGDPLPRESAYWYQQKPGQAPVVIIFNDIERPLGIPERFSGSRSGTTVTLTISGAQAEDEADYYCQSADSRKTFVFGTGTKLTVL

SEQ ID NO: 1225 - protein, 125 aa, Artificial Sequence
  Description of Artificial Sequence: Synthetic heavy chain variable region amino acid sequence
QVQLVQSGAEVKKPGSSVKVSCKASGGTFSTDAISWVRQAPGQGLEWMGGIIPLFGTANYAQKFQGRVTITADESTSTAYMELNSLRSVDTAVYYCGRTGAFDGEVVVRPHLDLWGQGTLVTVSS

SEQ ID NO: 1226 - protein, 110 aa, Artificial Sequence
  Description of Artificial Sequence: Synthetic light chain variable region amino acid sequence
QPVLTQPASVSGSPGQSITISCTGTSSDVGGYDYVSWYQHHPGKAPKLMIYEVSNRPSGVSNRFSGSKSGNTASLTISGLQADDEAAYYCSSYTRSNTLLFGGGTKLTVL

SEQ ID NO: 1227 - protein, 122 aa, Artificial Sequence
  Description of Artificial Sequence: Synthetic heavy chain variable region amino acid sequence
EVQLVESGGGLVHPGRSLRLSCGASGFTFRSFAMHWVRQAPGKGLEWVAVISYDGSDEYYADSVKGRFTISRDNSRNTLFLQMNRLRPEDTAIYYCARAYCSTSNCPVLDYWGQGTLVTVSS

SEQ ID NO: 1228 - protein, 109 aa, Artificial Sequence
  Description of Artificial Sequence: Synthetic light chain variable region amino acid sequence
QSVLIQPASVSGSPGQSITISCTGTSSDVGGYSLVSWYQQHPGKAPKLIIFEGNKRPAGVSDRFSGSKYGDTASLTISGLQAEDEADYYCCSYAGGHSVFGGGTKVTVL

SEQ ID NO: 1229 - protein, 126 aa, Artificial Sequence
  Description of Artificial Sequence: Synthetic heavy chain variable region amino acid sequence
QVQLVESGGGVVQPGRSLRLSCAASGFTFSSYAMQWVRQAPGKGLEWVAVMTNDGDDKYYADSVRGRFTISRDNSKNTLYLQMNNLRPEDTAVYYCARDLFEWWELLGYCYAMDVWGQGTTVTVSS

SEQ ID NO: 1230 - protein, 111 aa, Artificial Sequence
  Description of Artificial Sequence: Synthetic light chain variable region amino acid sequence
QSVLTQPPSASGSPGQSVTISCTGTSSDVGAYNYVSWYQQHPGKAPKLIIYEVYKRPSGVPDRFFGSKSGNTASLTVSGLQAEDEADYYCSSYAGSNTLGVFGGGTKVTVL

SEQ ID NO: 1231 - protein, 129 aa, Artificial Sequence
  Description of Artificial Sequence: Synthetic heavy chain variable region amino acid sequence
QVQLVQSGGGLVRPGGSLRVSCAASGFIFNNYALTWVRQAPGKGLEWVSAISGSGSSTYYADSVKGRFTISRENSNNRLYLQLSGLRAEDTAVYFCARVRGLVWFEGRIDPYPNVFDYWGQGTLVTVSS

SEQ ID NO: 1232 - protein, 104 aa, Artificial Sequence
  Description of Artificial Sequence: Synthetic light chain variable region amino acid sequence
DIVLTQSPGTLSLSPGERATLSCRASQSVSNDYLAWYQQKPGQAPRLLIYDASSRAIGIPDRFSGSGSGTDFTLIISRLEPEDFAVYYCHHPGKFGQGTKVEIK

SEQ ID NO: 1233 - protein, 125 aa, Artificial Sequence
  Description of Artificial Sequence: Synthetic heavy chain variable region amino acid sequence
EVQLVESGPGLVKPSQTLSLTCTVSGGSIRSHDYYWSWIRQPPGKGLEWIGYSYYSGSTYYNPSLKSRVIISLDTSKNQFSLNLTSVTAADTAMYYCARDRPHTSSWIPGWFDPWGQGTLVTVSS

SEQ ID NO: 1234 - protein, 110 aa, Artificial Sequence
  Description of Artificial Sequence: Synthetic light chain variable region amino acid sequence
SYELTQPPSASGTPGQRVTISCSGSSSNIGSNTVSWYQQFPGKAPKLLIYSNNERPSGGPDRFSGSKSGTSASLAIGGLQSEDEANYYCAAWDDSLYAVVFGGGTKLTVL

SEQ ID NO: 1235 - protein, 126 aa, Artificial Sequence
  Description of Artificial Sequence: Synthetic heavy chain variable region amino acid sequence
QVTLKESGPGLVKPSQTLSLTCTVSGGSISGGGYYWSWIRQLPGKGLQWIGCIYDSGTTYYNPSLKSLVTISIDTSKNQFSLKLSSVTAADTAVYYCARGGSLDDFWSATWYFALWGRGTLVTVSS

SEQ ID NO: 1236 - protein, 108 aa, Artificial Sequence
  Description of Artificial Sequence: Synthetic light chain variable region amino acid sequence
EIVLTQSPGTLSLSPGERATLSCRASQSVSSNYLAWYQQKPGQAPRLLIYGASSRATGIPDRFSGSGSGTDFTLTISRLEPEDFAFYYCQQYGRSPYTFGPGTKLEIK

SEQ ID NO: 1237 - protein, 128 aa, Artificial Sequence
  Description of Artificial Sequence: Synthetic heavy chain variable region amino acid sequence
QVQLVESGPRLVKPSQTLSLTCTVSGGSIYRGDYDWNWIRQPPGKGLEWIGYISYTGNTHYNSSLKSRLSISADTSGTHFSLKLSSVTAADTAIYYCARDVGYGGNAAHYYYYAMDVWGQGTTVTVSS

SEQ ID NO: 1238 - protein, 106 aa, Artificial Sequence
  Description of Artificial Sequence: Synthetic light chain variable region amino acid sequence
ETTLTQSPATLSLSPGERATLSCRASQSVGSSLAWYQQKVGQAPRLLIYDASSRVTGIPARFSGSGSGTDFTLTISSLEPGDFAVYYCQQRSNSLTFGGGTKVEIK

SEQ ID NO: 1239 - protein, 129 aa, Artificial Sequence
  Description of Artificial Sequence: Synthetic heavy chain variable region amino acid sequence
QVQLVESGGGLVKPGGSLRLSCAASGFPLSPYALNWVRQAPGKGLEWVSSITSSSAYIYYADSVKGRFTVSRDNPTNSLYLQMNSLRAEDTAVYYCARTIPQHYYDNNGDYYNYGMDVWGQGTTVTVSS

SEQ ID NO: 1240 - protein, 107 aa, Artificial Sequence
  Description of Artificial Sequence: Synthetic light chain variable region amino acid sequence
DIVLTQSPATLSVSPGQRITLSCRASQTVRSNLAWYQQKPGQPPRLLIYGASTRATGVPARFTGSGSGTEFTLTITSLQSDDFAVYYCHQYNDRPLTFGPGTKVEIK

SEQ ID NO: 1241 - protein, 126 aa, Artificial Sequence
  Description of Artificial Sequence: Synthetic heavy chain variable region amino acid sequence
EVQLVESGPGLVKPSQTLSLTCAISGDSVSSNSAAWNWIRQSPSRGLERMGRTYYRSKWYDDYAVSVKSRIIINPDTSKNQFSLQLNSVTPEDTAVYYCARGISTFGGVIYALEIWGQGTMVTVSS

SEQ ID NO: 1242 - protein, 110 aa, Artificial Sequence
  Description of Artificial Sequence: Synthetic light chain variable region amino acid sequence
SYVLTQPASVSGSPGQSITISCTGLTSDVGGYNFVSWYQQHPGKAPKLIIYDVSHRPSGVSNRFSGSESGNTASLTISGLQAEDEAHYYCSSYTRTSIVVFGGGTKLTVL

SEQ ID NO: 1243 - protein, 126 aa, Artificial Sequence
  Description of Artificial Sequence: Synthetic heavy chain variable region amino acid sequence
EVQLLESGPGLVKPSQTLSLTCTVSGGSISSGDYYWSWVRQPPGKGLEWIGNIYHSGSTYYKPSLKSRVSISLDTSKNQFSLKLSSVTAADTAIYYCARDGGENYVWGTFRFLDVWGQGTTVTVSS

SEQ ID NO: 1244 - protein, 108 aa, Artificial Sequence
  Description of Artificial Sequence: Synthetic light chain variable region amino acid sequence
DIRLTQSPGTLSLSPGERATLSCRASQSVSSSYLAWYQQKPGQAPRLLIYGVSSRATGIPDRFSGSGSGTDFTLTINRLEPEDFALYHCQQYGSSPHTFGQGTKVEIK

SEQ ID NO: 1245 - protein, 117 aa, Artificial Sequence
  Description of Artificial Sequence: Synthetic heavy chain variable region amino acid sequence
QVQLVQSGVEVKKPGESLKISCRGSGYSFYNYWIAWVRQKPGKGLEYMGTIYLDDSDTIYSPSFQGEVTISADKSINTAYLQWNSLKASDTANYYCARQMDFYFDVWGRGTLVTVSS

SEQ ID NO: 1246 - protein, 107 aa, Artificial Sequence
  Description of Artificial Sequence: Synthetic light chain variable region amino acid sequence
SYELTQPPSVSVSPGQTARITCSGDPLPRESAYWYQQKPGQAPVVVIFNDIERPLGIPGRFSGSRSGATATLTINGAQAEDEADYYCQSADSRKTFVFGAGTKLTVL

SEQ ID NO: 1247 - protein, 126 aa, Artificial Sequence
  Description of Artificial Sequence: Synthetic heavy chain variable region amino acid sequence
QVTLKQSGPALVKPTQTLTLTCTFSGFSLSTKRMGVSWIRQPPGKALEWLARIDWDDDKYYSTSLRTRLTISKDTSKNQVVLTMTDMDPVDTATYYCARIQPYTSGGYYSYYFDYWGQGTLVTVSS

SEQ ID NO: 1248 - protein, 107 aa, Artificial Sequence
  Description of Artificial Sequence: Synthetic light chain variable region amino acid sequence
DIQVTQSPSSLSASIGDRVTITCRASQTIASYLNWYQQKPGKAPKLLIYIASSLQSGVPSRFSGSGSGTDFTLTISTLQPEDFATYYCQQSYGTPWTFGQGTKVEIK

SEQ ID NO: 1249 - protein, 134 aa, Artificial Sequence
  Description of Artificial Sequence: Synthetic heavy chain variable region amino acid sequence
QVQLQESGPGLVKPSGTLSLTCAVSGGSISSSNWWNWVRQPPGKGLEWIGEIYHSGRTNYNPSLKSRVSISIDKFKSQFSLNLNSVTAADTAVYYCARDLPGTPYDIVPGYYPGLRRHDAFDIWGQGTMVTVSS

SEQ ID NO: 1250 - protein, 110 aa, Artificial Sequence
  Description of Artificial Sequence: Synthetic light chain variable region amino acid sequence
QSVLTQPPSASGTPGQRVTMSCSGSSSNIGSDTVNWYQQLPGTAPKLLIYSNNQRPSGVPDRFSGSKSGTSASLAISGLQSEDEADYYCAAWDDSLNGWVFGGGTKLTVL

SEQ ID NO: 1251 - protein, 126 aa, Artificial Sequence
  Description of Artificial Sequence: Synthetic heavy chain variable region amino acid sequence
EVQLVESGAEVKKPGASVKVSCKASGYTFNNYDISWVRQAPGQGLEWMGWISTYNGNTNYAQKFQGRATMTTDTSTTTAYMELRSLRSDDSAIYYCARVYCGGDCHNPFFLYFDLWGRGTLVTVSS

SEQ ID NO: 1252 - protein, 106 aa, Artificial Sequence
  Description of Artificial Sequence: Synthetic light chain variable region amino acid sequence
SYVLTQPLSVSVALGQTARITCGGNNIGSKSVHWYQQKPGQAPLLVIYRDNNRPSGIPERFSGSTSGNTATLTISRAQAGDEADYSCQVWDNSDWVFGGGTKLTVL

SEQ ID NO: 1253 - protein, 123 aa, Artificial Sequence
  Description of Artificial Sequence: Synthetic heavy chain variable region amino acid sequence
QVQLVQSGAEVKKPGSSVKVSCKAFGGIFSSYAISWVRQAPGQGLEWMGGIIPIFGTTKYAQKFQGRVTITADKSTSTVYMEVSSLRFEESAVYFCARAYCSGGTWYGGADYWGQGTLVTVSS

SEQ ID NO: 1254 - protein, 106 aa, Artificial Sequence
  Description of Artificial Sequence: Synthetic light chain variable region amino acid sequence
QSVLTQPPSVSVSPGQTARITCSGDVLPKQYAYWYQQKPGQAPLLVMYKDTERPSGIPERFSGSSSVTAVTLTISGVQAEDEADYYCQSADSTQELFGGGTKLTVL

SEQ ID NO: 1255 - protein, 117 aa, Artificial Sequence
  Description of Artificial Sequence: Synthetic heavy chain variable region amino acid sequence
EVQLLESGPGLVKPSETLSLTCAVSGGSISNYYWSWIRQPPGKGLEWIAYISYSGTTNYNPSLESRVTISVDTSKNQFSLKLNSVTAADTAVYYCARHEFLVLPDVWGQGTLVTVSS

SEQ ID NO: 1256 - protein, 108 aa, Artificial Sequence
  Description of Artificial Sequence: Synthetic light chain variable region amino acid sequence
ETTLTQSPGTLSLSPGERATLSCRASQSVSSTFLAWYQQKPGQAPRLLIYAASSRATGIPDRFSGSGSGTDFTLIISRLEPEDFAVYYCQQYRSSPFSFGPGTKVEIK

SEQ ID NO: 1257 - protein, 125 aa, Artificial Sequence
  Description of Artificial Sequence: Synthetic heavy chain variable region amino acid sequence
QVQLVQSGGGVVQPGRSLRLSCAASGFTFNNYGMHWVRQAPGKGLEWVAVLSFDGINKYYADSARGRFTISRDNSKNTLYLQMNSLRAEDTALYYCAKDRQEYSSGWTHDACDIWGQGTMVTVSS

SEQ ID NO: 1258 - protein, 107 aa, Artificial Sequence
  Description of Artificial Sequence: Synthetic light chain variable region amino acid sequence
EIVMTQSPATLSVSPGERATLSCRASQNVNNNLAWYQQNPGQAPRLLIFGASTRATGIPARFSGSGSGTEFTLTISSLQSEDFAVYYCQQYNNWPRTFGQGTKLEIK

SEQ ID NO: 1259 - protein, 121 aa, Artificial Sequence
  Description of Artificial Sequence: Synthetic heavy chain variable region amino acid sequence
EVQLVESGGGLVQPGGSLRLSCEASRFKFSTFWMAWVRQAPGKGLEWVANIKQDGSETYYLDSVKGRFTISRDNAKNSLFLQMKSLRAEDTAVYYCAGLWWGDLENWFDPWGQGTLVTVSS

SEQ ID NO: 1260 - protein, 111 aa, Artificial Sequence
  Description of Artificial Sequence: Synthetic light chain variable region amino acid sequence
QSVLTQPPSVSGAPGQRVTISCTGSSSNLGTGFDVHWYRQLPGTAPQLLIYGSTNRPSGVPDRFSGSKYGTSASLAITGLQAEDEADYYCQSYDSNLRAYVFGTVTKVTVL

SEQ ID NO: 1261 - protein, 123 aa, Artificial Sequence
  Description of Artificial Sequence: Synthetic heavy chain variable region amino acid sequence
EVQLLESGAEVKKPGSSVRVSCKAFGGTFSSYAFSWVRQAPGQGLEWMGGITPMFGTENYAPNFQGRVTITADKLTTTVYMELSRLRSEDSAVYYCAREGGRLGTTMGAFDMWGQGTMVTVSS

SEQ ID NO: 1262 - protein, 107 aa, Artificial Sequence
  Description of Artificial Sequence: Synthetic light chain variable region amino acid sequence
DIRLTQSPSSLSASVGDRVTITCRASHGISSALAWYQQRPGRVPQVLIFHASTLESGVPSRFSGSGSGTDFTLTISSLQPEDFATYYCQQFNSYPYTFGQGTKVEIK

SEQ ID NO: 1263 - protein, 127 aa, Artificial Sequence
  Description of Artificial Sequence: Synthetic heavy chain variable region amino acid sequence
QVQLQESGPGLVKPSQTLSLTCTVSGGSISSGDYYWSWIRQPPGKGLEWIGYIFYSGTTYYNPSLKSRVTISLDTSQNQFSLKLSSVTAADTAVYYCARDGDEVDYVWGTRRYLDSWGRGTLVTVSS

SEQ ID NO: 1264 - protein, 108 aa, Artificial Sequence
  Description of Artificial Sequence: Synthetic light chain variable region amino acid sequence
EIVLTQSPGTLSLSPGERATLSCRASQSVSSRYLAWYQQKPGQAPRLLIHGASSRATGIPDRFSGSGSGTDFTLTISRLEPEDFAVYYCLQYGSLPKTFGQGTKVEIK

SEQ ID NO: 1265 - protein, 117 aa, Artificial Sequence
  Description of Artificial Sequence: Synthetic heavy chain variable region amino acid sequence
QVQLVQSGVEVKKPGESLKISCRGFGYSAYNYWIAWVRQKPGKGLEYMGTIYLDDSDTIYSPSFQGEVTISADRSINTAYLQWNSLKASDTANYYCARQMDFYFDVWGRGTLVTVSS

SEQ ID NO: 1266 - protein, 107 aa, Artificial Sequence
  Description of Artificial Sequence: Synthetic light chain variable region amino acid sequence
QSVLTQPPSVSVSPGQTARITCSGDPLPRESAYWYQQKPGQAPVVVIFNDIERPLGIPARFSGSRSGTTVTLTISGAQAEDEADYYCQSADSRKTFVFGPGTKLTVL

SEQ ID NO: 1267 - protein, 121 aa, Artificial Sequence
  Description of Artificial Sequence: Synthetic heavy chain variable region amino acid sequence
QVQLVQSGAEVKKPGSSVRVSCKASGGSFSSYATSWVRQAPGQGLEWMGGIIPMYDAVNYAQKFQGRVTITADESTTTAYMELSSLRSEDTAVYYCARSSGYTGTNFFDYWGQGTLVTVSS

SEQ ID NO: 1268 - protein, 108 aa, Artificial Sequence
  Description of Artificial Sequence: Synthetic light chain variable region amino acid sequence
DIQMTQSPSSVSASVGDRVTITCRASQDISSWLAWYQQKPGKAPKLLIYTASSLQSGVPSRFSGSGSGTDFTLTISRLQPEDFATYYCQQANSFPRVTFGGGTKVEIK

SEQ ID NO: 1269 - protein, 123 aa, Artificial Sequence
  Description of Artificial Sequence: Synthetic heavy chain variable region amino acid sequence
EVQLLESGGGVVRPGGSLRLSCAASGFTFDDYAMGWVRQAPGKGLEWVSGITWNAGSTAYAGSVKGRFTISRDNAKNSLFLQMNSLRAEDTAFYLCARHVDSSGPVARHFDYWGQGTLVTVSS

SEQ ID NO: 1270 - protein, 110 aa, Artificial Sequence
  Description of Artificial Sequence: Synthetic light chain variable region amino acid sequence
NFMLTQPHSVSESPGKTVTISCTRSSGSIARNYVQWYQQRPGSAPTIVIYEDNQRPSGVPDRFSGSIDSSSNSASLTISGLKTEDEADYYCQSYDPSNVVFGGGTKLTVL

SEQ ID NO: 1271 - protein, 123 aa, Artificial Sequence
  Description of Artificial Sequence: Synthetic heavy chain variable region amino acid sequence
EVQLVESGGGLVQPGGSLRLSCAASGFTVSNNYMRWVRQAPGKGLEWVSVIYSSGSTDYADSVKGRFTISRDNSKNTLYLQMNSLRAEDTAVYYCARERTLFYYDSSGFFDYWGQGTLVTVSS

SEQ ID NO: 1272 - protein, 107 aa, Artificial Sequence
  Description of Artificial Sequence: Synthetic light chain variable region amino acid sequence
ETTLTQSPGTLSLSPGERATLSCRASQSVDSSYLAWYQQKPGQAPRLLIYGASNRATGIPDRFSGSGSGTDFTLTISRLEPEDFAVYYCQQYGRSLTFGGGTKLEIK

SEQ ID NO: 1273 - protein, 127 aa, Artificial Sequence
  Description of Artificial Sequence: Synthetic heavy chain variable region amino acid sequence
QVQLVQSGAEVKTPGSSVKVSCKASGGTFRSYPITWVRQAPGQGLEWMGTVIPVFDTVNYAPKFQGRVSITADESTNTAYMELSSLRSDDSAVYYCARDLGWLRPMTTVTSPHFDYWGQGTLVTVSS

SEQ ID NO: 1274 - protein, 110 aa, Artificial Sequence
  Description of Artificial Sequence: Synthetic light chain variable region amino acid sequence
QSVLTQPASVSGSPGQSITISCTGTSSDVGGYDFVSWYQQHPGKAPKLMISEVTDRPSGVSNRFSGSKSGNTASLTISGLQAEDEADYYCTSYTSSRTYVFGTGTKLTVL

SEQ ID NO: 1275 - protein, 129 aa, Artificial Sequence
  Description of Artificial Sequence: Synthetic heavy chain variable region amino acid sequence
QVQLVQSGAEVKKPGSSVKVSCKASGGTFSSYATHWVRQAPGQGLEWMGGIIPIFGRATYAQKFQGRVTISADESTSTAYMELSSLRSEDTAVYYCARGRDDRSGDHIAFLYHYGMDVWGQGSTVTVSS

SEQ ID NO: 1276 - protein, 110 aa, Artificial Sequence
  Description of Artificial Sequence: Synthetic light chain variable region amino acid sequence
QSVLTQPPSVSAAPGQKVSISCSGSSSNIGINHASWYQHLPGTAPKLLIYDNNKRPSGIPDRFSGSKSGTSATLGISGLQTGDEAAYYCGTWDTGLSAVVFGGGTKLTVL

SEQ ID NO: 1277 - protein, 125 aa, Artificial Sequence
  Description of Artificial Sequence: Synthetic heavy chain variable region amino acid sequence
QVQLVQSGAEVKKPGSSVKVSCKASGGTLTSYGVSWVRQAPGQGLEWMGGIIPIFGTVDYAQKFQGRVTITADEPTSTAYMELSSLTSDDTAVYYCARDPWVSGPVEFYYYFDVWGRGTLVTVSS

SEQ ID NO: 1278 - protein, 108 aa, Artificial Sequence
  Description of Artificial Sequence: Synthetic light chain variable region amino acid sequence
DIVLTESPATLSLSPGERATLSCRASQSINNRYLAWYQQKPGQAPRLLIFGASSRATGIPDRFSGSGSGTDFTLTISRLEPEDFAVYYCQQYGSTPPTFGQGTKVEIK

SEQ ID NO: 1279 - protein, 122 aa, Artificial Sequence
  Description of Artificial Sequence: Synthetic heavy chain variable region amino acid sequence
EVQLVESGGGLVKPGGSLRLSCAASGFTFSSYYMNWVRQAPGKGLEWVSSISGGSSYISYADSVKGRFTISRDNAKNSLYLQMNSLRAEDTAVYYCARVDTPMVRGYYFDYWGQGTLVTVSS

SEQ ID NO: 1280 - protein, 111 aa, Artificial Sequence
  Description of Artificial Sequence: Synthetic light chain variable region amino acid sequence
QSVLTQPPSVSGAPGRRVTISCTGSSSNIGAGYDVHWYQQLPGTAPKLLIFANSNRPSGVPDRFSGSKSGTSASLAITGLQAEDEADYYCQSYDSSLSGSVFGGGTKVTVL

SEQ ID NO: 1281 - protein, 122 aa, Artificial Sequence
  Description of Artificial Sequence: Synthetic heavy chain variable region amino acid sequence
EVQLVESGGGLVKPGGSLRLSCAASGSSFSSYYMNWVRQAPGKGLEWVSSISSSSTYIDYADSVKGRFTISRDNAKNSLFLQMNSLRAEDTAVYYCARVSSPMIRGYYLDYWGQGTLVTVSS

SEQ ID NO: 1282 - protein, 111 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLVIHGNSNRPSGVPDRFSGSKSGTSASLAITGLQGEDEADYYCQSYDSSLSGSVFGGGTKLTVL

SEQ ID NO: 1283 - protein, 118 aa, Artificial Sequence
  Description of Artificial Sequence: Synthetic heavy chain variable region amino acid sequence
EVQLVQSGAEVRKPGESLKISCKGSGYNFASYWIAWVRQMPGKGLEWMGIIFPGDSDTRYSPSFQGQVTISVDKSISTAYLQWSSLKASDTAIYYCATSKYTFGYLDWGQGTLVTVSS

SEQ ID NO: 1284 - protein, 110 aa, Artificial Sequence
  Description of Artificial Sequence: Synthetic light chain variable region amino acid sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDTSNQVFGTGTKVTVL

SEQ ID NO: 1285 - protein, 119 aa, Artificial Sequence
  Description of Artificial Sequence: Synthetic heavy chain variable region amino acid sequence
QVQLVQSGPEVKKPGESLKISCTLSASGLTTYWIGWVRQMPAKGLEWMGIIFPGDSDTRYSPSFQGQVTISADKSTNTAYLQWSGLKASDTAIYYCATLQTPVTGLDQWGQGTLVTVSS

SEQ ID NO: 1286 - protein, 110 aa, Artificial Sequence
  Description of Artificial Sequence: Synthetic light chain variable region amino acid sequence
NFMLTQPHSVSESPGKTVTISCTRSSGNIARSYVQWYQQRPGSAPTTVIHEDDQRPSGVPDRFSGSIDTSSNSASLTISGLKTEDEADYYCQSYDPSNYVFGTGTKVTVL

SEQ ID NO: 1287 - protein, 122 aa, Artificial Sequence
  Description of Artificial Sequence: Synthetic heavy chain variable region amino acid sequence
EVQLVESGPGLVKPSGTLSLTCAVSGGSVSSDNWWSWVRQPPGKGIEWIGEIYPSGGTNYNPSLNSRVTISVDKSKNQFSLKLNSVTAADTAIYYCARAPFDSSGYHSNSVWGQGTLVTVSS

SEQ ID NO: 1288 - protein, 112 aa, Artificial Sequence
  Description of Artificial Sequence: Synthetic light chain variable region amino acid sequence
ETTLTQSPLSLPVTPGEPASISCRSSQSLLHSNGHNYLDWYVQKPGQSPQLLIYLSSNRASGVPDRFSGSGSGTDFTLRISRVEAEDVGVYYCMQPLQTPQTFGQGTKVEIK

SEQ ID NO: 1289 - protein, 127 aa, Artificial Sequence
  Description of Artificial Sequence: Synthetic heavy chain variable region amino acid sequence
QVQLQESGPGLVKPSQTLSLTCAVSGGSISSGGYYWSWIRQHPGKGLEWIGYIYYSGSTYYNPSLKSPVTISVDTSKNQFSLKLTSVTAADTAVYYCARGDYYFDGSGRTTAAFDIWGQGTMVTVSS

SEQ ID NO: 1290 - protein, 107 aa, Artificial Sequence
  Description of Artificial Sequence: Synthetic light chain variable region amino acid sequence
DIQVTQSPSSLSASVGDRVTITCRASQSISTFLNWYQQKPGRAPKLLIYDASNLQSGVPSRVSGSGSGTDFTLTISSLHPEDFATYYCQQSYTTPYTFGQGTKVDIK

SEQ ID NO: 1291 - protein, 129 aa, Artificial Sequence
  Description of Artificial Sequence: Synthetic heavy chain variable region amino acid sequence
EVQLLESGGGLVQPGRSLRLSCTGSGFTFGDYAMNWVRQAPGKGLEWVGLIRSKDYGGTTEFAASLKGRLTISRDDSKSIAYLQMHSLKTEDSAVYYCTRAHLTDYTDINGYQYYFDYWGQGSPVTVSS

SEQ ID NO: 1292 - protein, 107 aa, Artificial Sequence
  Description of Artificial Sequence: Synthetic light chain variable region amino acid sequence
DIQMTQSPSSLSASVGDRVTITCQASQDISNFLNWYQQRPGKAPKLLIHDASNLETGVPSRFSGSGSRTEFTFTISSLQPEDIGTYYCQHYDNFPYTFGQGTKVEIK

SEQ ID NO: 1293 - protein, 123 aa, Artificial Sequence
  Description of Artificial Sequence: Synthetic heavy chain variable region amino acid sequence
EVQLVESGAGLVQPGGSLRLSCAASGFTFSTYAVSWVRQAPGKGLEWVSAISGSGASTYFADSVKGRFTISRDNSKNTLYLQMNSLRAEDTAVYYCAKARLELRPYYYGMDVWGQGTTVTVSS

SEQ ID NO: 1294 - protein, 110 aa, Artificial Sequence
  Description of Artificial Sequence: Synthetic light chain variable region amino acid sequence
QPVLTQPASVSGSPGQSITISCTGTSSDVGGYNFVSWYQQHPGKAPKLIIYEVSNRPSGVSNRFSGSKSGNTASLTISGLQAEDEADYYCSSSTLSTTYVFGTGTKVTVL

SEQ ID NO: 1295 - protein, 122 aa, Artificial Sequence
  Description of Artificial Sequence: Synthetic heavy chain variable region amino acid sequence
QVQLVQSGGGLVQPGGSLRLSCSASGFTFSSKSMHWVRQAPGKGLEYVSAIRSDGVSTYYGDSVKGRFTVSRDNAKNTVYLRMSSLRREDTAVYYCVKGPYGDFQYNWFDTWGQGTLVTVSS

SEQ ID NO: 1296 - protein, 109 aa, Artificial Sequence
  Description of Artificial Sequence: Synthetic light chain variable region amino acid sequence
ETTLTQSPATLSVSPGERATLSCRASQSVSSNLAWYQQKPGQAPRLLIYGASIRATGIPARFSGSGSGTEFTLTISSLQSEDFAVYYCQQYDNWPPGDTFGQGTKVEIK

SEQ ID NO: 1297 - protein, 128 aa, Artificial Sequence
  Description of Artificial Sequence: Synthetic heavy chain variable region amino acid sequence
EVQLVESGGGLVQPGGSLRLSCAASGFTFSSYRMNWVRQAPGKGLEWVSYIDISSSTIYYADSVKGRFTISRDNAKNSLYLQMNSLRAEDTAVYYCARDQLVWEPLIRNHYYYAMDVWGQGTTVTVSS

SEQ ID NO: 1298 - protein, 113 aa, Artificial Sequence
  Description of Artificial Sequence: Synthetic light chain variable region amino acid sequence
EIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSSPPTFGQGTKVEIK

SEQ ID NO: 1299 - protein, 117 aa, Artificial Sequence
  Description of Artificial Sequence: Synthetic heavy chain variable region amino acid sequence
EVQLVESGVEVKKPGESLKISCRGSGYSFHNYWIAWVRQKPGKGLEYMGTIYVDDSDTIYSPSFQGEVTISADKSINTAYLQWNSLKASDTANYYCARQMDFYFDVWGRGTLVTVSS

SEQ ID NO: 1300 - protein, 107 aa, Artificial Sequence
  Description of Artificial Sequence: Synthetic light chain variable region amino acid sequence
SYELTQPPSVSVSPGQTARITCSGDPLPRESAYWYQQKPGQAPVVVIFNDIERPLGIPERFSGSRSGTTVTLTISGAQAEDEADYYCQSADSRKTFVFGSGTKLTVL

SEQ ID NO: 1301 - protein, 125 aa, Artificial Sequence
  Description of Artificial Sequence: Synthetic heavy chain variable region amino acid sequence
EVQLLESGGGLVQPGGSLRLSCAASGFTFSSYAMSWVRQAPGKGLEWVSGISGSGGTTYYADSVKGRFTISRDNSKNTLYLQMNSLRAEDTAVYYCAKDSPVNINCGGDCDVAYWGQGTLVTVSS

SEQ ID NO: 1302 - protein, 107 aa, Artificial Sequence
  Description of Artificial Sequence: Synthetic light chain variable region amino acid sequence
EIVMTQSPSSLSASVGDTVTITCQASQDISYSLNWYQQKPGKAPNLLIFDASHLQTGVPSRFSGGGDGKHFSFTISSLQPEDVATYYCQQYDSLMYTFGQGTKVEIK

SEQ ID NO: 1303 - protein, 121 aa, Artificial Sequence
  Description of Artificial Sequence: Synthetic heavy chain variable region amino acid sequence
EVQLVESGGGLVKPGGSLRLSCTASGFTFSDYYMNWIRQAPGKGLEWVSYISGDGNTIYYTDSVKGRFTISRDNAKNSLFLQMNSLRGEDSAVYYCAGPVRGYTYGIFDYWGQGALVTVSS

SEQ ID NO: 1304 - protein, 109 aa, Artificial Sequence
  Description of Artificial Sequence: Synthetic light chain variable region amino acid sequence
YYVLTQPPSVSVAPGQAARITCGGNNIGSRSVNWYQQKPGQAPVVVIYGDSVRPSGIPERFSGSNSGNTATLTFSRVEAGDEADYYCQVWETNSDHPVVFGGGTKVTVL

SEQ ID NO: 1305 - protein, 118 aa, Artificial Sequence
  Description of Artificial Sequence: Synthetic heavy chain variable region amino acid sequence
QVQLVQSGAEVKKPGASVKVSCKASGYTFTNYDINWVRQATGQGLEWMGWMNRNNGNTGYARKFQGRVTMTRNTSISTAYMELSSLRSEDTAVYYCARGGDFYAMDVWGQGTTVTVSS

SEQ ID NO: 1306 - protein, 105 aa, Artificial Sequence
  Description of Artificial Sequence: Synthetic light chain variable region amino acid sequence
SYELTQPPSVSVSPGQTASITCSGDKLGDKYASWYQQKPGQSPVLVIYQDTKRPSGVPERFSGSNSGNTATLTISGTQAVDEADYYCQVWDGSIAFGGGTKVTVL

SEQ ID NO: 1307 - protein, 123 aa, Artificial Sequence
  Description of Artificial Sequence: Synthetic heavy chain variable region amino acid sequence
EVQLVESGGGLVQPGGSLRLSCAASGFTFSTYGMNWVRQAPGKGLEWVSYIGGSGRIIYYADSVKGRFTISRDNAKNSLYLQMNSLRAEDTAVYYCARDQHIVLVTGSTPDYWGQGTLVTVSS

SEQ ID NO: 1308 - protein, 107 aa, Artificial Sequence
  Description of Artificial Sequence: Synthetic light chain variable region amino acid sequence
EIVLTQSPSSLSASVGDRVTITCRASHAISNYLAWFQQKPGKAPKSLIYAASTLQSGVPSKFSGSGSGTDFTLTISSLQPEDFATYYCQQYSSYPLTFGGGTKVEIK

SEQ ID NO: 1309 - protein, 122 aa, Artificial Sequence
  Description of Artificial Sequence: Synthetic heavy chain variable region amino acid sequence
EVQLVESGGGLVKPGGSLRLSCEASGFTLTSYSMNWVRQAPGKGLEWVSSISSSSTYIHYADSVKGRFTISRDNAKNSLYLQMNSLRAEDTAVYYCARDKVMVTKYNGMDVWGQGTTVTVSS

SEQ ID NO: 1310 - protein, 111 aa, Artificial Sequence
  Description of Artificial Sequence: Synthetic light chain variable region amino acid sequence
QSVLTQPPAVSGAPGQRVTISCTGSSSNIGAGHDVHWYQQLPGTAPKLLIYGNSNRPSGVPDRFSGSKSGTSASLAITGLQAGDEADYYCQSYDSSLSGSLFGGGTKLTVL

SEQ ID NO: 1311 - protein, 119 aa, Artificial Sequence
  Description of Artificial Sequence: Synthetic heavy chain variable region amino acid sequence
EVQLVESGGGLVKPGGSLRLSCAASGFTISGYSMDWVRQAPGKGLEWVSSISSSSSYIHYADSVKGRFTISRDNAKNSLYLQMNSLRAEDTAVYYCATNPREGGAFDIWGQGTTVTVSS

SEQ ID NO: 1312 - protein, 111 aa, Artificial Sequence
  Description of Artificial Sequence: Synthetic light chain variable region amino acid sequence
QSVLTQPPSMSGAPGQRVTISCTGSSSNIGAGYDVHWYQQLPGTAPKLLIYNNSNRPSGVPDRFSASKSGTSASLAITGLQAEDEADYYCQSYDSSLSGYVFGTGTRVTVP

SEQ ID NO: 1313 - protein, 123 aa, Artificial Sequence
  Description of Artificial Sequence: Synthetic heavy chain variable region amino acid sequence
EVQLVESGGGLVQPGGSLRLSCAASGLTFSRYSMNWVRQAPGKGLEWVSYISSTGRRIQYADSVKGRFTISRDDGKNSLYLQMNSLRAEDTAVYYCARDPLNYHDNTAYWSYWGQGTLVTVSS

SEQ ID NO: 1314 - protein, 111 aa, Artificial Sequence
  Description of Artificial Sequence: Synthetic light chain variable region amino acid sequence
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNPLVFGGGTKLTVL

SEQ ID NO: 1315 - protein, 125 aa, Artificial Sequence
  Description of Artificial Sequence: Synthetic heavy chain variable region amino acid sequence
QVQLQESGGGVVQPGRSLRLSCAASGFAFSDYAMDWVRQAPGKGLEWVAVISFDGSNKFYADSVKGRFTISRDNSENTLFLQMNSLRAEDTAVYYCVRDFVPCSGATCYLPPVYWGRGTLVTVSS

SEQ ID NO: 1316 - protein, 108 aa, Artificial Sequence
  Description of Artificial Sequence: Synthetic light chain variable region amino acid sequence
EIVLTQSPATLSVSPGERATLSCRASQSVSSDLAWYQQKPGQAPRLLIYGASTRATGIPARFSGSGSGTEFTLTISRLQSEDFAVYFCQQYNNWPSWTFGQGTKVEIK

SEQ ID NO: 1317 - protein, 126 aa, Artificial Sequence
  Description of Artificial Sequence: Synthetic heavy chain variable region amino acid sequence
EVQLVESGGGLVQPGGSLRLSCAASGFTFSDHWMNWVRQTPGKGLEWVANIKPDGRETYYVDSVKGRFTISRDNSKKSVYLQMNSLRAEDTAVYYCVRDGHIVVVTAVPPGFFDLWGRGTLVTVSS

SEQ ID NO: 1318 - protein, 107 aa, Artificial Sequence
  Description of Artificial Sequence: Synthetic light chain variable region amino acid sequence
DIQVTQSPSSLSASVGDRVTITCQASQDLTKYLNWYQQKPGKAPKLLIYDISNLETGVPSRFSGSGFGTEFTLTISSLQPEDVATYYCQQYQNLPYTFGQGTKVEIK

SEQ ID NO: 1319 - protein, 123 aa, Artificial Sequence
  Description of Artificial Sequence: Synthetic heavy chain variable region amino acid sequence
QVQLVQSGAEVKKPGSSVKVSCKASGGTFSSYAITWVRQAPGQGLEWMGGIIPLFGTAKYAQQFQGRVTITADESTSTAYMELSSLRSEDTAVYYCARDGEVCTNGFCWFLDWGLGTLVTVSS

SEQ ID NO: 1320 - protein, 106 aa, Artificial Sequence
  Description of Artificial Sequence: Synthetic light chain variable region amino acid sequence
DIRVTQSPSSLSASVGDRVTITCQASQDISNYLNWYQQKPGKAPKLLIYDASKLETGVPSRFSGSGSGTDFTFTISSLQPEDIATYYCQNYGNFPHFGGGTKLEIK

SEQ ID NO: 1321 - protein, 122 aa, Artificial Sequence
  Description of Artificial Sequence: Synthetic heavy chain variable region amino acid sequence
EVQLLESGAEVKKPGASVKVSCKASGYTFTDHSIHWVRQAPGRGLEWMGWFNPHTGVTDYAQKFQGWVTMTSDTSISTAYMELSSLKSDDTAIYFCARDQWETDGAYFLDYWGQGTLVTVSS

SEQ ID NO: 1322 - protein, 109 aa, Artificial Sequence
  Description of Artificial Sequence: Synthetic light chain variable region amino acid sequence
QSALTQPASVSGSPGQSITISCTGTSSDVGNFKLVSWYQQHPGKAPKLMIYEGNKRPSGVSNRFSGSKSGNTASLTISGLQAEDEADYYCCSSAVSSTFFGTGTKLTVL

SEQ ID NO: 1323 - protein, 123 aa, Artificial Sequence
  Description of Artificial Sequence: Synthetic heavy chain variable region amino acid sequence
EVQLVESGGGLVKPGGSLRLSCATSGFTFSDYYMTWIRQAPGKGLEWVSYISSSGGYTNYADSVRGRFTISRDNAKRSLYLQMNSLRAEDTAVYYCARVEFSSGDVPSLFDSWGQGTLVTVSS

SEQ ID NO: 1324 - protein, 111 aa, Artificial Sequence
  Description of Artificial Sequence: Synthetic light chain variable region amino acid sequence
QSVLTQPPSVSGAPGQRVTISCTGSSSNLGAGYHVHWYQQFPGTAPKPLIYGNTNRPSGVPDRFSGSKSGTSASLAITGVQAEDEADYYCQSYDYSLSGWVFGGGTKLTVL

SEQ ID NO: 1325 - protein, 120 aa, Artificial Sequence
  Description of Artificial Sequence: Synthetic heavy chain variable region amino acid sequence
QVQLVQSGAEVKKPGESLKISCKASGYSSTTYWIGWVRQISGKGLEWMGIIYPGDSDTRYSPSFQGQVTISADRSTKTAYLQWSSLKASDTAMYYCGTSGFGVATPFDYWGQGTLVTVSS

SEQ ID NO: 1326 - protein, 111 aa, Artificial Sequence
  Description of Artificial Sequence: Synthetic light chain variable region amino acid sequence
NFMLTQPHSVSESPGKTVTISCTRTSGSIAGNYVHWYQQRPGSAPTTVIYEDNQRPSGVPDRFSGSIDRSSNSASLTISGLKTEDEADYYCQSYASGIHGVFGGGTKVTVL

SEQ ID NO: 1327 - protein, 124 aa, Artificial Sequence
  Description of Artificial Sequence: Synthetic heavy chain variable region amino acid sequence
QVQLVQSGAAVKRPGASVKVSCKASGYTFSTNALHWVRQAPGQSLEWMGWINTDNGIPKYSERFHGRVTFTRDTSASTVYMDLSGLRSGDTAVYYCARDGSSGHWLGLSVLDNWGQGTLVTVSS

SEQ ID NO: 1328 - protein, 111 aa, Artificial Sequence
  Description of Artificial Sequence: Synthetic light chain variable region amino acid sequence
QSALIQPASVSGSPGQSITISCTGTSDDVGAYNYVSWYQQYPNKAPKLVIYEVSHRPSGVSNRFSGSKSGNTASLTISGLQAEDEADYYCSSYTRSATPYVFGTGTKLTVL

SEQ ID NO: 1329 - protein, 124 aa, Artificial Sequence
  Description of Artificial Sequence: Synthetic heavy chain variable region amino acid sequence
EVQLVESGGGVVQPGRSLRLSCAASGFIFRNYGMHWVRQAPGKGLEWVAGTSFEGRNKDYGHSVKGRFTISRDNSKDTLYLQMNSLRPEDTAVYSCAKGSSLQWSHLDWYFDLWGRGTLVTVSS

SEQ ID NO: 1330 - protein, 103 aa, Artificial Sequence
  Description of Artificial Sequence: Synthetic light chain variable region amino acid sequence
DIVMTQSPSTLSASVGDRVTITCRASQSFSSWLAWYQQKPGKAPNLLIYDASTLESGVPSRFSGSGSGTEFTLTISSLQPDDFATYYCQQERTFGQGTKVEIK

SEQ ID NO: 1331 - protein, 127 aa, Artificial Sequence
  Description of Artificial Sequence: Synthetic heavy chain variable region amino acid sequence
EVQLVQSGGGVVQPGRSLRLSCAASGFTFSSYGMHWVRQAPGKGLEWVAVISHDGNNKYYGDSVKGRFTISRDNSKNTLHLQMNSLRGDDTAVYYCGKDPLKGDCSGGSCYQRIDYWGQGTLVTVSS

SEQ ID NO: 1332 - protein, 111 aa, Artificial Sequence
  Description of Artificial Sequence: Synthetic light chain variable region amino acid sequence
NFMLTQPHSVSESPGKTVTISCTGSSGRIASNYVQWYQQRPGSAPATVIYDDNQRPSGVPDRFSGSIDSSSNSASLTISGLKTEDEADYYCQSYDRSNHVIFGGGTKLTVL

SEQ ID NO: 1333 - protein, 126 aa, Artificial Sequence
  Description of Artificial Sequence: Synthetic heavy chain variable region amino acid sequence
EVQLVESGGGLVKPGGSLRLSCAASGFTFSGFSMNWVRQAPGKGLEWVSSISSTSRYIYYADSVQGRFTISRDNAKNSLYLQMNSLRAEDTAVYYCARDPGGSASFVPYYYGMDVWGQGATVTVSS

SEQ ID NO: 1334 - protein, 110 aa, Artificial Sequence
  Description of Artificial Sequence: Synthetic light chain variable region amino acid sequence
SYELIQPPSVSVSPGQTARITCSGDALPNQYVYWYQKKPGQAPVLVIYKDTEGPLGIPERFSGSSSGTTVTLTISGVQAEDEADYYCQSADSSGTYPYVVFGGGTKLTVL

SEQ ID NO: 1335 - protein, 127 aa, Artificial Sequence
  Description of Artificial Sequence: Synthetic heavy chain variable region amino acid sequence
QVQLQESGPRLVKPSQTLSLTCTVSGGSITTGEHYWSWIRQSPGRGLEWIGYISYSGSTYYNPSLKSRVTISVDTSKTRISLNLRSVTAADSAVYYCARDQEDSDYIWGSSRVFDIWGQGTMVTVSS

SEQ ID NO: 1336 - protein, 108 aa, Artificial Sequence
  Description of Artificial Sequence: Synthetic light chain variable region amino acid sequence
ETTLTQSPGTLSLSPGERATLSCRASQNVGNNYLAWYQQKPGQAPRVLIQDASTRATGIPDRFSGSGSGTDFTLTISRLEPEDFAVYHCQQYGSAPWTFGQGTKVEIK

SEQ ID NO: 1337 - protein, 123 aa, Artificial Sequence
  Description of Artificial Sequence: Synthetic heavy chain variable region amino acid sequence
QVQLVQSGAEVKKPGSSVKVSCKASGGISSSYAISWVRQAPGQGLEWMGGIIPIFGTTNYAQKFQGRVTITADKSTSTVYMELSSLRSEDSAVYFCARAYCSGGTCYGGADYWGQGTLVTVSS

SEQ ID NO: 1338 - protein, 106 aa, Artificial Sequence
  Description of Artificial Sequence: Synthetic light chain variable region amino acid sequence
SYELTQPPSVSVSPGQTARITCSGDVLPKQYAYWYQQKLGQAPLLVMYKDTERPSGIPERFSGSSSVTAVTLTISGVQAEDEADYYCQSADSTQELFGGGTKLTVL

SEQ ID NO: 1339 - protein, 123 aa, Artificial Sequence
  Description of Artificial Sequence: Synthetic heavy chain variable region amino acid sequence
QVTLKESGGGLVKPGGSLRLSCAASGFTFSDYFMTWIRQAPGKGLEWVSYISSNSGYTKYAEDVKGRFSISRDNAKKTLFLQLNSLSAEDTAVYYCARVEFSSGDVPSLFDLWGQGTLVTVSS

SEQ ID NO: 1340 - protein, 111 aa, Artificial Sequence
  Description of Artificial Sequence: Synthetic light chain variable region amino acid sequence
QSVLTQPPSVSGAPGQRVTISCTGSSSNIGAGYHVHWYQQLPGTAPKVLIHGNNNRPSGVPDRFSGSRSGTSASLAITGLQAEDEADYYCQSYDFSLSGWVFGGGTKLTVL

SEQ ID NO: 1341 - protein, 118 aa, Artificial Sequence
  Description of Artificial Sequence: Synthetic heavy chain variable region amino acid sequence
QVQLVQSGAEVKKPGSSVKVSCKASGGTFSNHAIDWVRQAPGQGLEWMGRIIPMVGLATYTRKFQGRVTISVDKSTSTAYMELSSLISDDTAVYYCARRTPEMAWGYWGQGTTVTVSS

SEQ ID NO: 1342 - protein, 106 aa, Artificial Sequence
  Description of Artificial Sequence: Synthetic light chain variable region amino acid sequence
DIVMTQTPSSLSASVGDRVTITCQASQDIRYYVNWYQQKPGKAPKLLIYDASTLETGVPSRFSGRGSGTDFTLIISSLQPEDIATYYCQQYGDLPTFGQGTRLEIK

SEQ ID NO: 1343 - protein, 122 aa, Artificial Sequence
  Description of Artificial Sequence: Synthetic heavy chain variable region amino acid sequence
QVQLVQSGGGVVQPGRSLRLSCATSGFTFSDYAIHWVRQAPGKGLEWVAVISYDGSHKYYGDSVKGRFTISRDNSKNTLYLQMNSLRPEDTAVYYCARSRSGSYYSSAIDNWGQGTLVTVSS

SEQ ID NO: 1344 - protein, 108 aa, Artificial Sequence
  Description of Artificial Sequence: Synthetic light chain variable region amino acid sequence
DIQMTQSPSSLSASVGDRVTIACRASQGISSALAWYRQRPGKAPELLIYDASTLESGVPSRFSGYGAGTDFTLTISSLQPEDFATYYCQQFNSYPSITFGQGTKVEIK

SEQ ID NO: 1345 - protein, 126 aa, Artificial Sequence
  Description of Artificial Sequence: Synthetic heavy chain variable region amino acid sequence
QVQLQESGGGVVQPGRSLRLSCAASGFTFSSYAMHWVRQAPGKGLEWVAVISFDGTANKYYADSVKGRFAISRDNSKNTLYLQMNSLRAEDTAVYYCAKDDAIYSGGWVGDAFDLWGQGTMVTVSS

SEQ ID NO: 1346 - protein, 107 aa, Artificial Sequence
  Description of Artificial Sequence: Synthetic light chain variable region amino acid sequence
EIVLTQSPATLSVSPGERATLSCRASQGVNSNLAWYQQKPGQAPRLLMYGASTRATGIPARFSGSGSETEFTLTISSLQSEDFAVYYCQQYNNWPRTFGQGTKVDIK

SEQ ID NO: 1347 - protein, 130 aa, Artificial Sequence
  Description of Artificial Sequence: Synthetic heavy chain variable region amino acid sequence
QVQLQQSGPGLVKPSQTLSLTCAISGDSVSSDSATWNWIRQSPSRGLEWLGRAYYRSKWYYDYAPSVKSRLTINPDTSKNQFSLQLTSVTPQDTAVYFCARDLPPLEYFDGSGYYFLDHWGQGTLVTVSS

SEQ ID NO: 1348 - protein, 108 aa, Artificial Sequence
  Description of Artificial Sequence: Synthetic light chain variable region amino acid sequence
SYELTQPPSVSVAPGQTARLSCGGHNIGSKSVQWYQQKPDQAPVLVVYDDHDRPSGIPDRFSGSNSGDMATLTISRVEAGDEADYYCQVCESGRDPMVFGGGTKVTVL

SEQ ID NO: 1349 - protein, 124 aa, Artificial Sequence
  Description of Artificial Sequence: Synthetic heavy chain variable region amino acid sequence
EVQLVESGPGLVKPSGTLSLTCAVSGDSISSSNWWSWVRQPPGKGLEWIGEVSHSGNTDYNPSLKSRVTISVDKSKNQFSLKLSSVTAADTAVYYCARPSPCSGGSCYWFFDLWGRGTLVTVSS

SEQ ID NO: 1350 - protein, 107 aa, Artificial Sequence
  Description of Artificial Sequence: Synthetic light chain variable region amino acid sequence
DIRLTQSPSSLSASVGDRVTITCRASQTINAYLNWYQQRPGKAPNLLIYAASSLQSGVPSRFSGSGSGTDFTLTISSLQPEDFATYYCQQSYKTAYTFGQGTKVEIK

SEQ ID NO: 1351 - protein, 120 aa, Artificial Sequence
  Description of Artificial Sequence: Synthetic heavy chain variable region amino acid sequence
QVQLVQSGAEVKKPGESLKISCKGSGYSFSSFWIGWVRQMPGKGLEWMGIIYPGDSDTRYSPSFKGQVTISADTSISTAYLQWSSLKASDTAMYYCAKSIVGSTGSFDPWGQGTLVTVSS

SEQ ID NO: 1352 - protein, 108 aa, Artificial Sequence
  Description of Artificial Sequence: Synthetic light chain variable region amino acid sequence
DIQMTQSPSSLSASVGDRVTITCQASQDISNFLNWYQQKPGKAPKLLIYDASNLRTGVPSRFSGSGSGTEFTFTISSLQPEDIATYYCQQYHDLPPLTFGGGTKVDIK

SEQ ID NO: 1353 - protein, 135 aa, Artificial Sequence
  Description of Artificial Sequence: Synthetic heavy chain variable region amino acid sequence
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCASSRAYYDILTGYYVASAETQTKAAFDIWGQGTTVTVSS

SEQ ID NO: 1354 - protein, 106 aa, Artificial Sequence
  Description of Artificial Sequence: Synthetic light chain variable region amino acid sequence
DIQVTQSPSSLSASVGDRVTITCQASQDISNYLNWYQQKPGKAPKLLIYDASNLETGVPSRFSGSGSGTDFSFTISSLQPEDIATYYCQQYDNLITFGQGTKVEIK

SEQ ID NO: 1355 - protein, 129 aa, Artificial Sequence
  Description of Artificial Sequence: Synthetic heavy chain variable region amino acid sequence
QVQLQESGPGLVKPSQTLSLTCTVSGDSISGGEHYWSWIRQPPGKGLEWIGSIYYSGTTYYNPSLKSRLTVSVDTFKNQFSLMLSYVTAADTAVYYCARDASPAYHDYIWGSCRYFDKWGQGTLVTVSS

SEQ ID NO: 1356 - protein, 108 aa, Artificial Sequence
  Description of Artificial Sequence: Synthetic light chain variable region amino acid sequence
EIVLTQSPGTLSLSPGERATLSCRASQSVSSNYLAWYQQKPGQAPRILIHGASSRATGIPDRFSGSGSGTDFTLTVSRLEPEDFAVYYCQQYGSTPYTFGQGTKVEIK

SEQ ID NO: 1357 - protein, 127 aa, Artificial Sequence
  Description of Artificial Sequence: Synthetic heavy chain variable region amino acid sequence
EVQLVESGGGLVQPGRSLRLSCAASGFTFDDYAMHWVRQAPGKGLEWVSGISWSGDTRGYAESVKGRFTITRDNAKKYLYLQMNSLRAEDTAFYYCAKDAYYFGSGNEKFYYGMDVWGQGTTVTVSS

SEQ ID NO: 1358 - protein, 107 aa, Artificial Sequence
  Description of Artificial Sequence: Synthetic light chain variable region amino acid sequence
DIVLTQTPATLSVSPGERATLSCRASQNVISNLAWYQQKPGQAPRLLIYGASTRATGIPARFSGSGSGTEFTLTISSLQSEDFAVYYCQQYNNWPQTFGQGTKVEIK

SEQ ID NO: 1359 - protein, 126 aa, Artificial Sequence
  Description of Artificial Sequence: Synthetic heavy chain variable region amino acid sequence
QVQLVQSGAEVKKPGSSVRVSCKASGGTFSRYAISWVRQAPGQGLEWMGGVIPRFDKTNYAQKFQGRVMITADKSTSTAYMELSSLRSDDTAVYYCAGDRLDTKITHTWYGFGDFWGQGTTVTVSS

SEQ ID NO: 1360 - protein, 108 aa, Artificial Sequence
  Description of Artificial Sequence: Synthetic light chain variable region amino acid sequence
EIVLTQSPGTLSLSPGERATLSCRASQSVTSNFLAWYQQRPGQAPRLLIYGASVRAIDIPDRFSGSGSGTDFTLTISRLEPEDFAVYYCQQYGDPFRTFGQGTKVEIK

SEQ ID NO: 1361 - protein, 126 aa, Artificial Sequence
  Description of Artificial Sequence: Synthetic heavy chain variable region amino acid sequence
EVQLVESGGGVVQPGRSLRLSCAASGFTFSSYGMHWVRQAPGKGLEWVAVIWYDGNNEKYADSVKGRFTISRDNSKNTLYLQMNSLRAEDTAVYYCARPTQKYSSSWYWEDSIDYWGQGTLVTVSS

SEQ ID NO: 1362 - protein, 112 aa, Artificial Sequence
  Description of Artificial Sequence: Synthetic light chain variable region amino acid sequence
QSVLTQPPSVFGAPGQRVTISCTGSSSNIGAGYPVHWYQQLPGTAPKLLIYGNSNRPSGVPDRFSGSKSGTSASLAITGLQAEDEADYYCQSYDSSLSGGVVFGGGTKLTVL

SEQ ID NO: 1363 - protein, 125 aa, Artificial Sequence
  Description of Artificial Sequence: Synthetic heavy chain variable region amino acid sequence
QVQLVQSGAEVKKPGASVKVSCKASGYTFTGNYIHWVRQAPGQGLEWMGGINPNSGATNYARKFQGRISMTRDTSINTAYMEVSSLRSDDTATYYCARDAPPVVIPAAIHWFDAWGQGTLVTVSS

SEQ ID NO: 1364 - protein, 110 aa, Artificial Sequence
  Description of Artificial Sequence: Synthetic light chain variable region amino acid sequence
SYELTQPPSASGTPGQRVTISCSGSSSNIGRNTVNWYQQFSGTAPRLLIYRTNQRPSGVPDRFSGSKSGTSASLVISGLQSEDEADYYCASWHDTLNDVVFGGGTKLTVL

SEQ ID NO: 1365 - protein, 120 aa, Artificial Sequence
  Description of Artificial Sequence: Synthetic heavy chain variable region amino acid sequence
EVQLVESGGGVVQPGRSLRLSCAASGFTFSNYAIHWVRQAPGKGLEWVAAISYDGGNKFYADSVKGRFTISRDNSRNTLYLQMNSLRPEDTAVYYCARDRWELNYGIDVWGQGTTVTVSS

SEQ ID NO: 1366 - protein, 109 aa, Artificial Sequence
  Description of Artificial Sequence: Synthetic light chain variable region amino acid sequence
SYELMQPPSVSVSPGQTARITCSGDALPKQYAYWYQQKPGQAPVLVIYKDSERPSGIPERFSGSTSGTTVTLTISGVQAEDEADYYCQSADSSSTFFYVFGTGTKLTVL

SEQ ID NO: 1367 - protein, 123 aa, Artificial Sequence
  Description of Artificial Sequence: Synthetic heavy chain variable region amino acid sequence
EVQLVESGGGLVKPGGSLRLSCAASGFSSSSYFMNWVRQAPGKGPEWVSSISGSSSFINYADSVKGRFTISRDNAKNSLYLQMNSLRAEDTAVYYCARAVLPAGVGGYWFDSWGQGTLVTVSS

SEQ ID NO: 1368 - protein, 111 aa, Artificial Sequence
  Description of Artificial Sequence: Synthetic light chain variable region amino acid sequence
QSVVTQPPSVSGAPGQRVTISCTGSSSNIGAGYDVHWYQHLPGRAPKLLIYGNSNRPSGVPDRFSGSKSGTSASLVITGLQAEDEADYCCQSYDSSLSGAVFGGGTQLTVL

SEQ ID NO: 1369 - protein, 119 aa, Artificial Sequence
  Description of Artificial Sequence: Synthetic heavy chain variable region amino acid sequence
EVQLLESGPGLVKPSETLSLTCTVSGGSISGYYWSWIRQPPGKGLEWIGYIYHSGGSTNYNPSLKSRVTISVDTSKNQFSLKVSSVTAADTAVYYCARLARVVTTFDFWGQGALVTVSS

SEQ ID NO: 1370 - protein, 110 aa, Artificial Sequence
  Description of Artificial Sequence: Synthetic light chain variable region amino acid sequence
QPVLTQPASVSGSPGQSITISCTGTSSDVGGYNYVSWYQQKPGTAPKLMIFDVSNRPSGVSNRFSGSKSDNTASLTISGLQAEDEADYYCSSYTSSTNLVFGGGTKLTVL

SEQ ID NO: 1371 - protein, 117 aa, Artificial Sequence
  Description of Artificial Sequence: Synthetic heavy chain variable region amino acid sequence
EVQLVESGGGVVQPGGSLRLSCAASGFEFRDYAMHWVRQAPGKGLEWVALISYDGSKIHYADSVQGRFSISRDNSKNSLYLQMNSLRSEDSAKYYCVQDHWLVPAFWGQGAQVTVSS

SEQ ID NO: 1372 - protein, 110 aa, Artificial Sequence
  Description of Artificial Sequence: Synthetic light chain variable region amino acid sequence
QPVLTQPASVSGSPGQWITISCTGTSSDIGYYDYVSWYQQYPGKAPKLIIYEVSHRPSGVSNRFSGSKSGNTASLSISGLQAEDEADYYCSSYTTSNAGVFGTGTKLTVL

SEQ ID NO: 1373 - protein, 118 aa, Artificial Sequence
  Description of Artificial Sequence: Synthetic heavy chain variable region amino acid sequence
QVQLVQSGAEVKKPGESLKISCKGSGYSFTSYWIGWVRQMPGKGLEWMGIIYPGDSDTRYSPSFQGQVTISADKSTSTAYLQWSSLKASDSAMYYCARSEFSSSFDFWGQGTLVTVSS

SEQ ID NO: 1374 - protein, 111 aa, Artificial Sequence
  Description of Artificial Sequence: Synthetic light chain variable region amino acid sequence
NFMLTQPHSVSESPGKTVTISCTGSSGSIASYYVQWYQLRPGSAPTTVIYEDNQRLSGVPDRFSGSIDSSSNSASLTISGLKTEDEADYYCQSYRSGIPWVFGGGTKLTVL

SEQ ID NO: 1375 - protein, 122 aa, Artificial Sequence
  Description of Artificial Sequence: Synthetic heavy chain variable region amino acid sequence
QVQLVQSGAEVKKPGSSVKVSCKASGGTFNTYAISWVRQAPGQGLEWMGGIIPILGVSNYAQRFQGRVTFSADELTNTAYMELSSLRSEDTAVYFCARPVGAYTLGDAFEIWGRGTTVTVSS

SEQ ID NO: 1376 - protein, 112 aa, Artificial Sequence
  Description of Artificial Sequence: Synthetic light chain variable region amino acid sequence
QPVLTQSSSASASLGSSVKLTCTLSSGHSDFIIAWHQQQPGKAPRYLMKFEGNGRYSKGSGIPDRFSGSSSGADRCLTISNLQSEDEADYYCETWDSNTHVVFGGGTKLTVL

SEQ ID NO: 1377 - protein, 124 aa, Artificial Sequence
  Description of Artificial Sequence: Synthetic heavy chain variable region amino acid sequence
EVQLVESGGGLVNPGGSLRLSCVVSGFAFSSYGMNWVRQAPGKGLEWVSSISASSSYIDYADSVKGRFIISRDNAKNSLHLQMNSLRAEDTAVYYCARLGYDSSTYYTNWFDPWGRGTLVTVSS

SEQ ID NO: 1378 - protein, 111 aa, Artificial Sequence
  Description of Artificial Sequence: Synthetic light chain variable region amino acid sequence
QSVVTQEPSVSGAPGQRVTISCTGSSSNIGTGYDVHWYQQLPGAAPKLLIYGNSNRPSGVPDRISGSKSGTSASLAITGLQAEDEADYYCQSYDSSLSGYVFGTGTKVTVL

SEQ ID NO: 1379 - protein, 121 aa, Artificial Sequence
  Description of Artificial Sequence: Synthetic heavy chain variable region amino acid sequence
EVQLVESGGGLVKPGGSLRLSCAASGFKFSSYYLNWVRQAPGKGLEWVSSISGGSSYINYADSVKGRFTISRDNAKNTLDLQMSNLRAEDTAVYYCARVVGATGPLYFDLWGRGTLVTVSS

SEQ ID NO: 1380 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQFPGTAPKLLIYGNNNRPSGVPDRFSGSKSGTSASLAITGLQAEDEADYYCQSYDSSLSGYVFGAGTKVTVL

SEQ ID NO: 1381 - protein, 121 aa, Artificial Sequence
  Description of Artificial Sequence: Synthetic heavy chain variable region amino acid sequence
EVQLLESGAEVKKPGASVKVSCKASGYTFTNYGISWVRQAPGQGLEWMGWISAYNGNTNYAQKLQGRVTMTTDTSTSTAYMELRSLRSDDTAVYYCARDGGVIAAATLGYWGQGTLVTVSS

SEQ ID NO: 1382 - protein, 112 aa, Artificial Sequence
  Description of Artificial Sequence: Synthetic light chain variable region amino acid sequence
EIVLTQSPLSLPVTLGQPASISCRSSQSLVYSDGNTYLSWFQQRPGQSPRRLIYKISNRDSGVPNRFSGSGSGTDFTLKISRVEAEDVGIYYCMQGIYWPPTFGQGTKVEIK

SEQ ID NO: 1383 - protein, 123 aa, Artificial Sequence
  Description of Artificial Sequence: Synthetic heavy chain variable region amino acid sequence
QVQLVQSGAEVKKPGASVKVSCKASGYTFTTFAIHWVRQAPGQRLEWMGWINAGNGNTKYSQKFQGRVTITRDTSASTAYMELSSLRSEDTAVYYCARPEISSSSLNEKDDYWGQGTLVTVSS

SEQ ID NO: 1384 - protein, 110 aa, Artificial Sequence
  Description of Artificial Sequence: Synthetic light chain variable region amino acid sequence
QPVLTQPASVSGSPGQSITISCTGTSSDVGAYDFVSWYQQHPGKAPKFMIYEVSHRPSGVSNRFSGSKSGNTASLTISGLQAEDEADYYCSSYTTSNTLVFGGGTKLTVL

SEQ ID NO: 1385 - protein, 119 aa, Artificial Sequence
  Description of Artificial Sequence: Synthetic heavy chain variable region amino acid sequence
EVQLLESGGGLIQPGGSLRLSCAASKFTFSDYEMNWVRQAPGKGLEWLSYISSSGGIMYYADSVKGRFTISRDNAKNSLYLQMNSLRAEDTAVYFCARAGRLLSGLDVWGHGTTVTVSS

SEQ ID NO: 1386 - protein, 107 aa, Artificial Sequence
  Description of Artificial Sequence: Synthetic light chain variable region amino acid sequence
EIVLTQSPSTLSASVGDRVTITCRASQSISPWLAWYQQKPGKAPKLLIYRASSLETGVPPRFSGSGSGTEFTLTISSLQPDDFATYYCQHYNSYLYSFGQGTKVEIK

SEQ ID NO: 1387 - protein, 121 aa, Artificial Sequence
  Description of Artificial Sequence: Synthetic heavy chain variable region amino acid sequence
EVQLLESGGGLVHPGRSLRLSCAASGFTFGDYAMHWVRQAPGKGLEWVSGISWNSDTIEYADSVKGRFTISRDNAKNSLYLQMNSLRAEDTALYYCAKDFGSSWEAYFDYWGQGTLVTVSS

SEQ ID NO: 1388 - protein, 107 aa, Artificial Sequence
  Description of Artificial Sequence: Synthetic light chain variable region amino acid sequence
DIVLTQSPSYLSASVGDRVTITCRASQSISTYLNWYQQKPGKAPKLLISAASSLQSGVTSRFSGSGSGTDFSLTISSLQPEDFATYYCQQSYSTALTFGGGTKVEIK

SEQ ID NO: 1389 - protein, 129 aa, Artificial Sequence
  Description of Artificial Sequence: Synthetic heavy chain variable region amino acid sequence
EVQLVESGGGLVKPGGSLRLSCAASGFTFGTYTMNWVRQAPGKGLEWVSSISSSSSHIYYADSVKGRFTISRDNARKALYLQMNSLRPEDTAVYFCARFLGDYGGDGNTYYYYYGMDVWGQGTTVTVSS

SEQ ID NO: 1390 - protein, 111 aa, Artificial Sequence
  Description of Artificial Sequence: Synthetic light chain variable region amino acid sequence
EIVMTQSPLSLPVTPGEPASISCRSSQSLLHSNGKNYLDWYLQKPGQSPQLLIHLGSNRASGVPDRFSGSGSGTDFTLQISRVEAEDVGVYYCMQALQTPTFGGGTKLEIK

SEQ ID NO: 1391 - protein, 128 aa, Artificial Sequence
  Description of Artificial Sequence: Synthetic heavy chain variable region amino acid sequence
QVQLVQSGAEVKKPGSSVKVSCKASGGTFSSYGISWVRQAPGQGLEWMGGIIPIFGTVSYAQKFRGRLTITAHEPTSTAYMDLSSLRSEDTAVYYCARINGRGWELSSLNYYYGMDVWGQGTTVTVSS

SEQ ID NO: 1392 - protein, 108 aa, Artificial Sequence
  Description of Artificial Sequence: Synthetic light chain variable region amino acid sequence
EIVLTQSPGTLSLSPGERGTLSCRASQSVASSYLAWYQQKPGQAPRLLIYGATSRATGIPDRFSGSGSGTDFTLTISRLEPEDFAVYYCQQYGSSLFTFGGGTKVDIK

SEQ ID NO: 1393 - protein, 122 aa, Artificial Sequence
  Description of Artificial Sequence: Synthetic heavy chain variable region amino acid sequence
EVQLLESGGGLVQPGGSLRLSCAASGFSFSIYSMNWVRQAPGKGLEWISYITSTGSPTYYADSVKGRFTISRDNAKNSLYLQMSSLRAEDTAVYYCVTYCSSSSCPAEFDYWGQGTLVTVSS

SEQ ID NO: 1394 - protein, 108 aa, Artificial Sequence
  Description of Artificial Sequence: Synthetic light chain variable region amino acid sequence
EIVLTQSPATLSLSPGERATLSCRASQSVNSYLAWYQQKPGQAPRLLIYDASNRATGIPARFSGSGSGTDFTLTISSLEAEDFAVYYCQHRNNWPALTFGGGTKVEIK

SEQ ID NO: 1395 - protein, 126 aa, Artificial Sequence
  Description of Artificial Sequence: Synthetic heavy chain variable region amino acid sequence
EVQLVESGGNLVQPGGSLRLSCAASGFTFSSYVMNWVRQAPGKGLEWVSGISGSGGTSYYADSVKGRFTISRDNSNNTLYLQMKSLRAEDTAVYYCAKDPRFQKWLIEGTNWFDSWGQGTLVTVSS

SEQ ID NO: 1396 - protein, 107 aa, Artificial Sequence
  Description of Artificial Sequence: Synthetic light chain variable region amino acid sequence
DIQVTQSPSSLSASVGDRVTITCRASQDVSNYLAWFQQKPGTAPKSLIYAASILQSGVPSKFRGSGSGTDFSLTISSLQPEDFATYYCQQYRSFPPTFGGGTKVEIK

SEQ ID NO: 1397 - protein, 119 aa, Artificial Sequence
  Description of Artificial Sequence: Synthetic heavy chain variable region amino acid sequence
EVQLVESGGGLVQPGGSLRLSCAASGFTFSSNAMSWVRQAPGKGLEWVSYISGGSATKSYADSVKGRFTISRDNSKNTLYLQMKSLRAEDTAVYYCVGGSAYYSGFDYWGQGTLVTVSS

SEQ ID NO: 1398 - protein, 108 aa, Artificial Sequence
  Description of Artificial Sequence: Synthetic light chain variable region amino acid sequence
DIVMTQSPSSLSASVGDRVTISCRASQDIRNYLAWYQQKPGKVPNLLIYAASTLESGVPSRFSGSGYGTDFTLTISGLQPEDVATYYCQKYDSAPPFTFGPGTKVDIK

SEQ ID NO: 1399 - protein, 118 aa, Artificial Sequence
  Description of Artificial Sequence: Synthetic heavy chain variable region amino acid sequence
QVQLVESGAEVKKPGESLKISCRDSGYSFSSFWIGWVRQMPGKGLEWVGIIYPGDSDIRYSPSFQGRVTISADKSISTAYLQWRSLKASDSAMYYCARSEKLGSFDRWGQGTLVTVSS

SEQ ID NO: 1400 - protein, 107 aa, Artificial Sequence
  Description of Artificial Sequence: Synthetic light chain variable region amino acid sequence
DIQMTQSPSSLSASVGDRVTITCQANRDISNCLNWYQQRPGKAPELLIYDASYLETGVPSRFTGSGSGTDFTFTISSLQPEDIATYYCQQYDNLLFTFGPGTKVEIK

SEQ ID NO: 1401 - protein, 122 aa, Artificial Sequence
  Description of Artificial Sequence: Synthetic heavy chain variable region amino acid sequence
QVQLVQSGAEVKKPGASVKVSCKASGYTFTNYGISWVRQAPGQGLEWMGWISAYNGNTNYAQKFQDRVTMTTDTSTSTAYMELRSLRYDDTAVYYCARDTPGEYASAMFDHWGQGTLVTVSS

SEQ ID NO: 1402 - protein, 112 aa, Artificial Sequence
  Description of Artificial Sequence: Synthetic light chain variable region amino acid sequence
DIVMTQSPLSLPVTLGQPASISCRSSQSLVYSDGNTYLSWFQQRPGQSPRRLIYKVSNRDSGVPDRFSGSGSGTDFTLKISGVEAEDVGVYYCMQGTHWPPTFGQGTKLEIK

SEQ ID NO: 1403 - protein, 117 aa, Artificial Sequence
  Description of Artificial Sequence: Synthetic heavy chain variable region amino acid sequence
EVQLLESGGGLAQPGRSLKVSCAASGVTVTSTYMGWVRQAPGKGLQWVSVIYSDGTTYYADSVKGRFTISRDHYKNTLYLQMNSLRAEDTALYYCARGNRRTDFGYWGQGTLVTVSS

SEQ ID NO: 1404 - protein, 106 aa, Artificial Sequence
  Description of Artificial Sequence: Synthetic light chain variable region amino acid sequence
EIVMTQSPSTLSASVGDRVTITCRASQTISNWLAWYQQKPGKAPKLLIYQASTLESGVPSRFSGSGSGTEFTLTISSLQPDDFATYYCQQYNTYYTFGPGTKVEIK

SEQ ID NO: 1405 - protein, 126 aa, Artificial Sequence
  Description of Artificial Sequence: Synthetic heavy chain variable region amino acid sequence
QVTLKESGPALVKPTQTLTLTCTFSGFSLSTSRTRVSWIRQPPGKALEWLARVDWDDDKFYNPVLKTRLSISKDPSKNQVVLTMTNVDPVDTATYYCVRMAHYGSGGYYVEYFQDWGQGTLVTVSS

SEQ ID NO: 1406 - protein, 108 aa, Artificial Sequence
  Description of Artificial Sequence: Synthetic light chain variable region amino acid sequence
DIQLTQSPASLSASAGDRVTITCRASQNINRYLNWYQQQSGKAPKLLIYAASILQSGVPSRFSGSGSGTDFTLTITSLQPEDFAIYYCQQSYTTPKYTFGQGTKVEIK

SEQ ID NO: 1407 - protein, 124 aa, Artificial Sequence
  Description of Artificial Sequence: Synthetic heavy chain variable region amino acid sequence
EVQLVESGGGLVKPGGSLRLSCAASGFKFSSYTMNWVRQAPGKGLEWVSSITGGSSFINYADSVKGRFTISRDNAKNSLYLQMVSLRAEDTAVYYCARDLSSHITIFGAVSDYWGRGTTVTVSS

SEQ ID NO: 1408 - protein, 110 aa, Artificial Sequence
  Description of Artificial Sequence: Synthetic light chain variable region amino acid sequence
QSVLTQPPSVSGAPGQRVTISCTGSSSNIGAGYDAHWFQQLPGSAPKLLIYANTNRPSGVPDRFSGSKSGTSASLAITGLQAEDEADYYCQSYDSTLSVVFGGGTKLTVL

SEQ ID NO: 1409 - protein, 125 aa, Artificial Sequence
  Description of Artificial Sequence: Synthetic heavy chain variable region amino acid sequence
QVQLVESGGGLVKPGGSLRLSCAASGFTFSSYSMNWVRQAPGKGLEWVSSISAGSSYIYYADSLKGRFTISRDNAKNSLYLQMNSLRAEDTAVYYCARVNTHYYDSSAYHNFDSWGQGTLVTVSS

SEQ ID NO: 1410 - protein, 112 aa, Artificial Sequence
  Description of Artificial Sequence: Synthetic light chain variable region amino acid sequence
QPVVTQPPSVSGAPGQRVTISCTGSSSNIGAGYDVHWYQQLPGTAPKLLIYGNTNRPSGVPERFSGSKSGTSASLAITGLQAEDEADYYCQSYDTNLSAPWVFGGGTKLTVL

SEQ ID NO: 1411 - protein, 127 aa, Artificial Sequence
  Description of Artificial Sequence: Synthetic heavy chain variable region amino acid sequence
EVQLVESGGGLVKPGGSLRLSCAASGLSFTDAWMGWVRQAPGKGLEWVGHIKKKTDYGPTAYAAPVRGRFTVSRDDSKNTLYLQMTSLKTEDTAVYYCITERGYNFGYNDYFGVDVWGQGTLVTVSS

SEQ ID NO: 1412 - protein, 109 aa, Artificial Sequence
  Description of Artificial Sequence: Synthetic light chain variable region amino acid sequence
QPGLTQPPSVSVSPGQTARITCSGDALPKKYAYWYQQKSGQAPVMIIYEDNKRPSGIPERFSGSTSGTMATLTISGAQMEDEADYYCFSTDSGDDQSGVFGGGTRLTVL

SEQ ID NO: 1413 - protein, 125 aa, Artificial Sequence
  Description of Artificial Sequence: Synthetic heavy chain variable region amino acid sequence
EVQLVESGGGLVQPGRSLRLSCAASGFTFDDYAMHWVRQAPGKGLEWVSGISWNSGSVGYSDSVKGRFTISRDNAKSSLYLQMNNLRAEDTALYYCARDMAHTQDYFDTSEYDSWGQGTLVTVSS

SEQ ID NO: 1414 - protein, 110 aa, Artificial Sequence
  Description of Artificial Sequence: Synthetic light chain variable region amino acid sequence
QPVLTQPASVSGSPGQSITISCTGTSSDIGAYNYVSWYQQHPGKAPKLVVYEVNNRPSGISNRFSGSKSGNTASLTISGLQAEDEADYYCSSYTVSATLVFGGGTKLTVL

SEQ ID NO: 1415 - protein, 122 aa, Artificial Sequence
  Description of Artificial Sequence: Synthetic heavy chain variable region amino acid sequence
EVQLLESGGGVVQPGRSLRLSCAASGFTFSSYAMHWVRQAPGKGLEWVAVISYDGSNKYYADSVKGRFTISRDNSKNTLYLQMNSLRAEDTAVYYCARVPCSSTSCYTTDYWGQGTLVTVSS

SEQ ID NO: 1416 - protein, 109 aa, Artificial Sequence
  Description of Artificial Sequence: Synthetic light chain variable region amino acid sequence
QPVLTQPPSVSGSPGQSVTISCTGTSSDVGSYNRVSWYQQPPGTAPKLMIYEVSNRPSGVPDRFSGSKSGNTASLTISGLQAEDEADYYCSSYTSSSPVFGGGTKVTVL

SEQ ID NO: 1417 - protein, 129 aa, Artificial Sequence
  Description of Artificial Sequence: Synthetic heavy chain variable region amino acid sequence
QVQLVESAAEVKRPGASLKVSCKASGYTFIDYDISWVRQAPGQGLDWMGWISTYDGSAKYPENLQARVAMTTDTSTSTAYMELESLTSDDTAVYYCARARRGSSGWVSTTGPTPFFDYWGRGTLVTVSS

SEQ ID NO: 1418 - protein, 109 aa, Artificial Sequence
  Description of Artificial Sequence: Synthetic light chain variable region amino acid sequence
SYELTQPPSVSVSPGQTARITCSGDALPKRYAYWYQQKSGQAPVLVIYEDNKRPSGIPERFSGSSSGTVATLTISGAQVEDEADYSCYSTDATGNHRGLFGGGTKLTVL

SEQ ID NO: 1419 - protein, 120 aa, Artificial Sequence
  Description of Artificial Sequence: Synthetic heavy chain variable region amino acid sequence
QVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSWNRNDYWGQGTLVTVSS

SEQ ID NO: 1420 - protein, 111 aa, Artificial Sequence
  Description of Artificial Sequence: Synthetic light chain variable region amino acid sequence
QSVLIQPASVSGSPGQSITISCTGTSSDVGGYNYVSWYQQHPGKAPKLMIYDVSNRPSGVSNRFSGSKSGNTASLTISGLQAEDEADYYCSSYTSSSTLVVFGGGTKVTVL

SEQ ID NO: 1421 - protein, 122 aa, Artificial Sequence
  Description of Artificial Sequence: Synthetic heavy chain variable region amino acid sequence
QVQLVQSGAEVREPGASVKVSCKPSGYTFANYGISWVRQAPGQGLEWMAWISAYNGNTNYAPKVQGRVSVTTDSSTGIGYMELRSLRSDDTAVYYCVRDTPAIAGAATLDFWGQGTLVTVSS

SEQ ID NO: 1422 - protein, 112 aa, Artificial Sequence
  Description of Artificial Sequence: Synthetic light chain variable region amino acid sequence
DIVLTQSPLSLAVTPGQSASISCRSRQSHVFSDGNTYVSWFQQRPGRSPRRLIYRVSYRDSGVPDRFSGSGSGSDFTLRISRVEAEDVGVYYCMQGTHWPRTFGQGTKLEIK

SEQ ID NO: 1423 - protein, 126 aa, Artificial Sequence
  Description of Artificial Sequence: Synthetic heavy chain variable region amino acid sequence
EVQLLESGPAVVKPTQTLTLTCTVSGLSLSSPRMSVSWIRQPPGKGLEWLARIDWDGDKYYGTSLKTRLSISKDTSKNQVVLTMTNMDPVDTGTYYCAQTSIYASNAYYLARLDPWGQGMLVTVSS

SEQ ID NO: 1424 - protein, 107 aa, Artificial Sequence
  Description of Artificial Sequence: Synthetic light chain variable region amino acid sequence
EIVMTQSPSLLSASVGDRVTITCRASQNIATYLNWYQQKPGKAPRLLIYAASNLQSGVPSGFSGSGSGTVFTLTISSLQPEDFATYFCQQSYETSLTFGGGTKVEIK

SEQ ID NO: 1425 - protein, 119 aa, Artificial Sequence
  Description of Artificial Sequence: Synthetic heavy chain variable region amino acid sequence
QVQLVESGPGLVKPSETLSLTCTVSGGSIGGYYWSWIRQPPGKGLEWIGYMYYSGSTNYNPSLKSRVTMSVDTSKNQFSLKLTSVTAADTAVYYCARVLRFLVGGMDVWGQGTTVTVSS

SEQ ID NO: 1426 - protein, 110 aa, Artificial Sequence
  Description of Artificial Sequence: Synthetic light chain variable region amino acid sequence
QSVLIQPASVSGSPGQSITISCTGTSSDVGGYNYVSWYQQHPGKAPKLIIYEVSNRPSGVSNRFSGSKSGNTASLTISGLQAEDEADYYCNSYTTIATLVFGTGTKVTVL

SEQ ID NO: 1427 - protein, 129 aa, Artificial Sequence
  Description of Artificial Sequence: Synthetic heavy chain variable region amino acid sequence
QVQLVQSGAEVKKPGSSVKVSCKASGGTFSSYAISWVRQAPGQGLEWMGGIIPIFGTVNYAQKFPGRVTITADESTSTAYMELSSLRSEDTAIYYCARDSPSYTGSLLFSQYYYGMDVWGQGTTVTVSS

SEQ ID NO: 1428 - protein, 110 aa, Artificial Sequence
  Description of Artificial Sequence: Synthetic light chain variable region amino acid sequence
QPVLTQPASVSGSPGQSITISCTGTSSDVGGYDYVSWYQHHPGKAPKLMIYEVSNRPSGVSNRFSGSKSGNTASLTISGLQAEDEADYYCSSFTTSSPRVFGTGTKLTVL

SEQ ID NO: 1429 - protein, 122 aa, Artificial Sequence
  Description of Artificial Sequence: Synthetic heavy chain variable region amino acid sequence
QVQLVQSGAEVKKPGASVRVSCTASGYRFFTYGITWVRQAPGQGLEWMGWISAYNGNTKFAQKFQGRLTMTTDAPTSTADMELRGLRSDDTAVYYCAREEGGYHGTGSNNYWGQGTLVTVSS

SEQ ID NO: 1430 - protein, 110 aa, Artificial Sequence
  Description of Artificial Sequence: Synthetic light chain variable region amino acid sequence
QSVLTQPPSVSAAPGQKVTISCSGSGSNVGGNDVSWYQQFPGTAPKLLIYDNSKRPSGIPDRFSGSKSGTSATLVITGLQTGDEADYYCGTWDSSLSVGVFGTGTKLTVL

SEQ ID NO: 1431 - protein, 123 aa, Artificial Sequence
  Description of Artificial Sequence: Synthetic heavy chain variable region amino acid sequence
QVQLVQSGAEVKKPGYSVKVSCKASGGTFSTFGISWVRQAPGLGLEWMGGIIPLFGTADYSKKYQGRVTITADESTSTGYMELNSLTPEDTAVYYCARSPGHLWSRYDAFEVWGQGTTVTVSS

SEQ ID NO: 1432 - protein, 111 aa, Artificial Sequence
  Description of Artificial Sequence: Synthetic light chain variable region amino acid sequence
QPVLTQPRSVSGSPGQSVTISCSGTSSDVGGYNYVSWYQQYPGKAPKLIIYDVNKRPSGVPDRFSGSKSDNTASLTISGLQADDESDYFCCSYAGSHTFEVFGTGTKVTVL

SEQ ID NO: 1433 - protein, 122 aa, Artificial Sequence
  Description of Artificial Sequence: Synthetic heavy chain variable region amino acid sequence
EVQLLESGGGAVQPGRFLRLSCAASGFTFRSYGMHWVRQAPGKGLEWVAVISYDGSDKYYADSVKGRFTISRDNSKNTLFLLMNGLRAEDAAVYYCAKDIASAGTLRGSDVWGQGTMVTVSS

SEQ ID NO: 1434 - protein, 110 aa, Artificial Sequence
  Description of Artificial Sequence: Synthetic light chain variable region amino acid sequence
QPVLTQPRSVSGSPGQSVTISCTGTSSDVGGFNYVSWYQQHPGKAPKLMIYDVRVRPSGVPDRFSGSKSGNTASLTISGLQGEDEADYYCCSYTVTYTLVFGGGTKLTVL

SEQ ID NO: 1435 - protein, 125 aa, Artificial Sequence
  Description of Artificial Sequence: Synthetic heavy chain variable region amino acid sequence
EVQLVESGGGLVQPGRSLRLSCEASGFTFDDYAMHWVRQTPGKGLEWVSGISWNSGSIVYADSVKGRFTISRDNAKNSLYLQMHSLRPEDTALYYCAKDNYTFGNYYYYYGMDVWGQGTTVTVSS

SEQ ID NO: 1436 - protein, 107 aa, Artificial Sequence
  Description of Artificial Sequence: Synthetic light chain variable region amino acid sequence
EIVLTQSPVTLSVSPGERATLSCRASQNVISNLAWYQQKPGQAPRLLIYGASTRATGIPARFSGSGSGTEFTLTISSLQSEDFAVYYCQQYNNWPLSFGGGTKVEIK

SEQ ID NO: 1437 - protein, 130 aa, Artificial Sequence
  Description of Artificial Sequence: Synthetic heavy chain variable region amino acid sequence
EVQLLESGGGLVKPGGSLRLSCAASGFTFSSYSLNWVRQAPGKGLEWVSSISSSGTYIFYADSVKGRFTISRDNAKDSLFLQMNSLRAEDTAVYYCARARDMGNYDILTGYYRVDAFDIWGQGTMVTVSS

SEQ ID NO: 1438 - protein, 110 aa, Artificial Sequence
  Description of Artificial Sequence: Synthetic light chain variable region amino acid sequence
QSVLTQPPSASKTPGQRVTISCSGSSSNIGGNTVNWYQQLPGTAPKLLIYTNDQRPSGVPDRFSGSKSGTSASLAISGLQSEDEADYYCAAWDDSLNGWVFGGGTKLTVL

SEQ ID NO: 1439 - protein, 125 aa, Artificial Sequence
  Description of Artificial Sequence: Synthetic heavy chain variable region amino acid sequence
EVQLLESGGGVVQPGRSLRLSCAASGFTFSDYAMHWVRQAPGKGLEWVALISFDGSNEYYADSVKGRFTISRDNSRNTVYLQVNTLRPDDTAVFYCARDSHLRLTTRGWGSFDYWGQGTLVTVSS

SEQ ID NO: 1440 - protein, 110 aa, Artificial Sequence
  Description of Artificial Sequence: Synthetic light chain variable region amino acid sequence
NFMLTQPHSVSESPGKTVTIACTRSSGSIARNYVQWYQQRPGRSPTMVIYEDNQRPSGVPDRFSGSIDTSSNSASLTISGLKTEDEADYYCQPYDPDNLVFGGGTKLTVL

SEQ ID NO: 1441 - protein, 125 aa, Artificial Sequence
  Description of Artificial Sequence: Synthetic heavy chain variable region amino acid sequence
QVQLVQSGGEVKKPGASVKVSCKASGYTFTHYGISWARQAPGQGIEWMGWINVHNGNTEYAQRFQGRVTMTTDTSTNTAYMEMTSLTSDDTAVYYCARDKIVVVVVPNYHGMDVWGQGTLVTVSS

SEQ ID NO: 1442 - protein, 113 aa, Artificial Sequence
  Description of Artificial Sequence: Synthetic light chain variable region amino acid sequence
EIVLTQSPDSLAVSLGERATINCKSSQSVLYRANNRNYLAWYQQKPGQPPKLLIYWASTRESGVPDRFSGSGSGTDFTLTISSLQAEDVALYYCHQYHSSPRTFGQGTKVDIK

SEQ ID NO: 1443 - protein, 120 aa, Artificial Sequence
  Description of Artificial Sequence: Synthetic heavy chain variable region amino acid sequence
QVQLVQSGAEMRRPGSSVRLPCKASGYTFVSHTIVWVRQAPGQGLEWMGGIIPSLRTPNYAQNFQDRLTITADESARTAYMELSSLTSNDTAVYYCARETFQGGYYLDYWGQGTLVTVSS

SEQ ID NO: 1444 - protein, 108 aa, Artificial Sequence
  Description of Artificial Sequence: Synthetic light chain variable region amino acid sequence
EIVMTQSPGTLSVSPGDTAALSCRASQSVGRNLAWYQQKPGQAPRLLIFGASTRAADIPGRFSGSGSGTEFTLTITSLQSEDFAVYYCQQYNKWPPYTFGQGTKVEIK

SEQ ID NO: 1445 - protein, 121 aa, Artificial Sequence
  Description of Artificial Sequence: Synthetic heavy chain variable region amino acid sequence
QVQLVQSGTEVKNPGASVKVSCKASGYTFSNYGITWVRQAPGQGLEWMAWISAYNGNILYAQNVQGRVTMTTDTSTSTGYMELRSLRSDDTAVYYCARDAPAGTLTLLDYWGQGTLVTVSS

SEQ ID NO: 1446 - protein, 112 aa, Artificial Sequence
  Description of Artificial Sequence: Synthetic light chain variable region amino acid sequence
DIVMTQTPLSLPVTLGQPASISCRPSQSLVYSDGNTYLNWFQQRPGQSPRRLIYKVSNRDSGVPDRFSGSGSGTDFTLRISRVEAEDVGVYYCMQGSHWPYAFGQGTKVEIK

SEQ ID NO: 1447 - protein, 130 aa, Artificial Sequence
  Description of Artificial Sequence: Synthetic heavy chain variable region amino acid sequence
EVQLVESGGGLVKPGGSLRLSCAVSGFTFSDYTMNWVRQAPGKGLEWVSSISGSGTYIYYGDSVKGQFTISRDNAKNSLYLQMNSLRAEDTAVYYCARELPAKTIFGVDFLGGTTAYDCWGQGTPVTVSS

SEQ ID NO: 1448 - protein, 106 aa, Artificial Sequence
  Description of Artificial Sequence: Synthetic light chain variable region amino acid sequence
EIVLTQSPATLSVSPGERATLSCRASQSVSSNLAWYQQKPGQAPRLLIYSATTRATGVPARFSGSGSGTEFTLTISSLRSEDFAVYYCQQYNNGGTFGPGTKVEIK

SEQ ID NO: 1449 - protein, 123 aa, Artificial Sequence
  Description of Artificial Sequence: Synthetic heavy chain variable region amino acid sequence
EVQLVQSGPGLVKPSETLSLTCSVSGASISRYHYYWGWIRQSPGKGLEWIGTIYYSGTTYYNPSLESRVTISADTSKNQVSLKLTSVTAADTAVYYCARGSGDTALDFSFEYWGQGALVTVSS

SEQ ID NO: 1450 - protein, 107 aa, Artificial Sequence
  Description of Artificial Sequence: Synthetic light chain variable region amino acid sequence
DIQLTQSPSFLSASVGDRITITCRASQGISNSLAWYQQKPGKAPKLLIYAASTLQFAVPSRFSGSGSGTEFTLTISSLQPEDFATYYCQQLDSYPLTFGGGTKLEIK

SEQ ID NO: 1451 - protein, 126 aa, Artificial Sequence
  Description of Artificial Sequence: Synthetic heavy chain variable region amino acid sequence
EVQLLESGGGLVQPGRSLRLSCAASGFTFDDYAMHWVRQAPGKGLEWVSGISWHSGSIVYADSVKGRFTISRDNAKNSLYLQMSSLRAEDTALYYCVKDHYNWNDNPHFHYGLDVWGQGTTVTVSS

SEQ ID NO: 1452 - protein, 107 aa, Artificial Sequence
  Description of Artificial Sequence: Synthetic light chain variable region amino acid sequence
EIVLTQSPATLSVSPGERATLSCRASQSVISNLAWYQQKPGQAPRLFIYGASTRATGIPARFSGSGSGTEFTLTISSLQSEDFAVYFCQQYNNWPITFGQGTRLEIK

SEQ ID NO: 1453 - protein, 119 aa, Artificial Sequence
  Description of Artificial Sequence: Synthetic heavy chain variable region amino acid sequence
EVQLVESGGGVVQPGKSLRLSCAASGFTFSSYAMHWVRQAPGKGLEWVSVIWYEDSDKYYGDSVKGRFTISRDNSKNTLYLQMNSLRAEDTAVYYCARKSGGFGGLDYWGQGTLVTVSS

SEQ ID NO: 1454 - protein, 112 aa, Artificial Sequence
  Description of Artificial Sequence: Synthetic light chain variable region amino acid sequence
DIVMTQSPLSLPVTPGEPASISCKSSQSLLTANGYNYLDWYVQKPGQSPHVLISLGSNRASGVPDRFSGSGSGTDFTLKISRVEAEDVGVYYCMQAIETPITFGQGTRLEIK

SEQ ID NO: 1455 - protein, 119 aa, Artificial Sequence
  Description of Artificial Sequence: Synthetic heavy chain variable region amino acid sequence
EVQLVESGPRLVKPSQTLSLTCTVSGGSIGTGDYHWTWIRQSPGKGLEWIGNIYYNGRTFYNPSLKGRGSISRDASKNQFSLNLSSVSAADTAVYYCARDRAAKGFDHWGQGTLVTVSS

SEQ ID NO: 1456 - protein, 107 aa, Artificial Sequence
  Description of Artificial Sequence: Synthetic light chain variable region amino acid sequence
DIQLTQSPSTLSASVGDRVTITCRASQNINGWLAWYQQKPGRVPKLLIYKASTLESGVPSRFSGSASGTEFTLTINNLLPDDFATYYCQQYNDYPYTFGQGTKVEIK

SEQ ID NO: 1457 - protein, 124 aa, Artificial Sequence
  Description of Artificial Sequence: Synthetic heavy chain variable region amino acid sequence
QVQLVQSGAEVKRPGSSVKVSCKAFGGSFSNYAINWVRQAPGQGLEWMGGISPVLGTAIYAKRFQGKVTITADKFANTAYMDLSSLRFEDTAVYYCARSPPHVEFPLTKWFDPWGQGTLVTVSS

SEQ ID NO: 1458 - protein, 108 aa, Artificial Sequence
  Description of Artificial Sequence: Synthetic light chain variable region amino acid sequence
EIVMTQSPGTLSLSPGERATLSCRASQSVNSGYLAWYQHKPGRAPRLLIYGASNRATGVPDRFSGSGSGTDFTLTISRLEPEDFAVYYCQQYDNSLFTFGPGTKVDIK

SEQ ID NO: 1459 - protein, 122 aa, Artificial Sequence
  Description of Artificial Sequence: Synthetic heavy chain variable region amino acid sequence
EVQLLESGGGLVQPGGSLRLSCAASGFTYYSYAMNWVRQAPGKGLEWVSAISGGGDNTFYAESVKGRFTISRDNAKNTLYLQMDSLRAEDTAVYYCAKDLQGYTSLYCFDYWGQGTLVTVSS

SEQ ID NO: 1460 - protein, 108 aa, Artificial Sequence
  Description of Artificial Sequence: Synthetic light chain variable region amino acid sequence
EIVMTQSPATLSLSPGERAALSCRASQSVFNYVAWYQQKPGQAPRLLIYDTSKRATGIPARFSGSGSGTDFTLTISSLEPEDFAVYYCQHRYNWPGLIFGGGTKVEIK

SEQ ID NO: 1461 - protein, 124 aa, Artificial Sequence
  Description of Artificial Sequence: Synthetic heavy chain variable region amino acid sequence
EVQLLESGGGLVQPGGSLRLSCAASGFTFSTYAMNWVRQAPGKGLEWVSTISGSGGSTYYGDSVKGRFTISRDNSKNTLYLQMNSLRAEDTAVYYCAKAPTPWCSGGSCYVSYWGQGTLVTVSS

SEQ ID NO: 1462 - protein, 108 aa, Artificial Sequence
  Description of Artificial Sequence: Synthetic light chain variable region amino acid sequence
DIVMTQTPGTLSLSPGERGTLSCRASQSVSSSYLAWYQQKPGQAPRLLIYGASSRATGIPDRFGGSGSGTDFTLTISTLEPEDFAVYYCQQYQSSPWTFGQGTKLEIK

SEQ ID NO: 1463 - protein, 127 aa, Artificial Sequence
  Description of Artificial Sequence: Synthetic heavy chain variable region amino acid sequence
TVQLVESGAEVKSPGSSVRVSCQASGGSSNSYAISWVRQAPGQGLEWMGMISPLFGTTRFSQRFQGRVTITADKSTSTAYMELSSLNSEDTALYYCARGRFDFWSGPTRFYYTMDVWGQGTMVTVSS

SEQ ID NO: 1464 - protein, 110 aa, Artificial Sequence
  Description of Artificial Sequence: Synthetic light chain variable region amino acid sequence
QSVLIQPASVSGSPGQSITISCSGTSSDIGGYNYVSWYQQHPGKAPKLLISDVTDRPSGISDRFSGSKSGTSASLTISGLQADDEADYYCTSYTTSSTWVFGGGTKLTVL

SEQ ID NO: 1465 - protein, 123 aa, Artificial Sequence
  Description of Artificial Sequence: Synthetic heavy chain variable region amino acid sequence
EVQLVESGGGLVKPGGSLRLSCAASGFSFSSYRVNWVRQAPGKGLEWVSSITGGSSFIDYADSVKGRFTISRDNAKNSLFLQMNSLRAEDTAVYFCARDSMTTVTNSLAFDIWGQGTMVTVSS

SEQ ID NO: 1466 - protein, 110 aa, Artificial Sequence
  Description of Artificial Sequence: Synthetic light chain variable region amino acid sequence
QSVLTQPPSVSGAPGQRVTISCTGSSSNIGVGYDVQWYQQLPGTAPKLLIYSNNKRPSGVPDRFSGSKSGTSASLAITGLQAEDEADYYCQSYDRSLSVVFGGGTKVTVL

SEQ ID NO: 1467 - protein, 123 aa, Artificial Sequence
  Description of Artificial Sequence: Synthetic heavy chain variable region amino acid sequence
EVQLVESGGGLVKPGGSLRLSCAASGFAFSSYGINWVRQVPGKRLEWVSSISGGSSFINYADSVKGRFTISRDNAGNSVYLQMNSLRAEDTAVYFCARESYGSGSSLNWFDPWGQGTLVTVSS

SEQ ID NO: 1468 - protein, 111 aa, Artificial Sequence
  Description of Artificial Sequence: Synthetic light chain variable region amino acid sequence
QSVLTQPPSVSGAPGQRVTISCTGSGSNIGAGYDVHWYQQLPGIAPRLVIFGNRNRPSGVPDRISGSKSDTSASLAITGLQAEDEGDYYCQSYDKRLSGWVFGGGTKLTVL

SEQ ID NO: 1469 - protein, 123 aa, Artificial Sequence
  Description of Artificial Sequence: Synthetic heavy chain variable region amino acid sequence
EVQLVESGGGLVQPGGSLRLSCAAAGFTFNNYEMHWVRQAPGKGLEWVSCVTSSGTATYYADSVKGRFTVSRDNAKKSLQLQMNSLRAEDTAVYYCARELYLGEDYYYGLDVWGQGTTVTVSS

SEQ ID NO: 1470 - protein, 107 aa, Artificial Sequence
  Description of Artificial Sequence: Synthetic light chain variable region amino acid sequence
SYELTQPPSVSVSPGQTASISCSGDKLRNKHTCWYQHKSGQSPVLLIYQDNRRPSGIPDRLSGSKSGTTATLTISWTQAMDEAEYYCQAWDSNSAVIFGGGTKLTVL

SEQ ID NO: 1471 - protein, 120 aa, Artificial Sequence
  Description of Artificial Sequence: Synthetic heavy chain variable region amino acid sequence
QVQLVQSGAELKKPGASVKVSCKASGHTFATYAIHWVRQAPGQSLEWLGWINTANGDTKYSQKFRATVTIHGDTSANTVYLELSRLRSEDTAVYYCASPPLVGAINLEFWGPGTLVTVSS

SEQ ID NO: 1472 - protein, 110 aa, Artificial Sequence
  Description of Artificial Sequence: Synthetic light chain variable region amino acid sequence
QSVLTQPASVSGSVGQSITISCTGTSSDVGGYNSVSWYQHHPDKAPKLIIYEVSNRPSGVSHRFSGSKSGNTASLTISGLQAEDEADYYCSSYTTSDTLIFGGGTKVTVL

SEQ ID NO: 1473 - protein, 117 aa, Artificial Sequence
  Description of Artificial Sequence: Synthetic heavy chain variable region amino acid sequence
QVQLVQSGAEVRKPGASVKVSCKASGYTFSIYDMNWVRQAPGQGLEWMGWMNPNSGNTGYAQKFQGRVTMTGDTSISTAYMELSSLTSEDTAVYYCAVMYGDYPGYWGQGSLVTVSS

SEQ ID NO: 1474 - protein, 106 aa, Artificial Sequence
  Description of Artificial Sequence: Synthetic light chain variable region amino acid sequence
SYELTQPLSVSVALGQTARITCGGNNIGSKSVHWYQQKPGQAPVLVIYRDAKRPSGIPERFSGSNSGNTATLTISGAQAGDEADYYCQVWDSNAWIFGGRTKLTVL

SEQ ID NO: 1475 - protein, 122 aa, Artificial Sequence
  Description of Artificial Sequence: Synthetic heavy chain variable region amino acid sequence
QVQLVQSGAEVKKPGASVKVSCKASGYTFTHFGISWVRQAPGQGLEWMGWISIYNGNTNYAQKIQGRATMTTDASTSTAYMELRSLTSDDTAVYYCAREPPSTTAAATSDYWGQGTLVTVSS

SEQ ID NO: 1476 - protein, 112 aa, Artificial Sequence
  Description of Artificial Sequence: Synthetic light chain variable region amino acid sequence
DIVMTQSPLSLPVTLGQPASISCRSSQSLVYIEGNTYLSWFQQRPGQSPRRLIYKVSNRDSGVPDRFSGSGSGTDFTLKISRVEAEDVGLYYCMQGTHWPRTFGQGTKLEIK

SEQ ID NO: 1477 - protein, 134 aa, Artificial Sequence
  Description of Artificial Sequence: Synthetic heavy chain variable region amino acid sequence
QVQLQESGPGLVKPSQTLSLTCSVSEGSVISGDYYWSWIRQSPGKGLEWLGYIHYSGSTYYNPSLKSRVTISVDTSKKQFSLKLSSVTAADTAVYYCARDLGCIGGVCSAYGLEHNYYFGMDVWGQGTTVTVSS

SEQ ID NO: 1478 - protein, 108 aa, Artificial Sequence
  Description of Artificial Sequence: Synthetic light chain variable region amino acid sequence
EIVLTQSPATLSLSPGERATLSCRASQSVSSYLAWYQQKPGQAPRLLIYTASNRATGIPARFSGSGSGTDFTLTISSLEPEDFAVYYCQQRSSWPPYTFGQGTKLEIK

SEQ ID NO: 1479 - protein, 116 aa, Artificial Sequence
  Description of Artificial Sequence: Synthetic heavy chain variable region amino acid sequence
EVQLLESGGGLFHPGGSLTLSCVASGFTLSTYYMHWVRQAPGKGLVWVARINSDGGYTTYADSVKGRFTVSRDNAKNTLYLQMNSLRVEDTAVYYCAREWVEFDSWGQGTLVTVSS

SEQ ID NO: 1480 - protein, 110 aa, Artificial Sequence
  Description of Artificial Sequence: Synthetic light chain variable region amino acid sequence
NFMLTQPHSVSASPGKTVTISCTRSSGNIASNYVQWYQQRPGSSPTTVITEDNQRPSGVPDRFSGSIDSSSNSASLTISGLKTEDEADYYCQSYDSSTYVFGTGTKLTVL

SEQ ID NO: 1481 - protein, 117 aa, Artificial Sequence
  Description of Artificial Sequence: Synthetic heavy chain variable region amino acid sequence
EVQLVESGGGLVRPGGSLRVSCAASGFTFIRYDMHWVRQAPGKGLEWVSGIGTAGDTYYAASVQGRFTISRENAKNSLYLQMSNLRPGDTAVYYCAGSMAATGIDQWGQGTLVTVSS

SEQ ID NO: 1482 - protein, 112 aa, Artificial Sequence
  Description of Artificial Sequence: Synthetic light chain variable region amino acid sequence
EIVMTQSPLTLPVTPGEPASISCRSSQSLLHSNGFTYLDWFLQKPGQSPQLLIFLGSNRASGVPDRFSGSGSGTDFTLKISRVEAEDVGIYYCMQALQTPYTFGQGTKVEIK

SEQ ID NO: 1483 - protein, 123 aa, Artificial Sequence
  Description of Artificial Sequence: Synthetic heavy chain variable region amino acid sequence
EVQLLESGSGLVKPSQTLSLTCAVSGDSLNSALYSWSWIRQPPGKGLEWIGYIYYSGSTYYNSSLKSRVTISIDRSKNQFSLNLNSVTAADTAVYYCASLQTGYSSGWFFDFWGPGTLVTVSS

SEQ ID NO: 1484 - protein, 107 aa, Artificial Sequence
  Description of Artificial Sequence: Synthetic light chain variable region amino acid sequence
EIVLTQSPGTLSLSPGERATLSCRASQSVSRTYLTWYQQKPGQAPRLLIYGASNRATGIPDRFSGSGSGTDFTLTISRLEPEDFAVYYCQQYGSTPLFGQGTKVEIK

SEQ ID NO: 1485 - protein, 119 aa, Artificial Sequence
  Description of Artificial Sequence: Synthetic heavy chain variable region amino acid sequence
QVQLVESGGGLVQPGGSLRLSCAASGFPFSAYGINWVRQAPGKGLEWVSYISSTSTTIKYADSVKGRFTISRDDAKNSLYLQLRSLRPEDTAVYYCAGGVWSGYYIDFWGQGTPVTVSS

SEQ ID NO: 1486 - protein, 110 aa, Artificial Sequence
  Description of Artificial Sequence: Synthetic light chain variable region amino acid sequence
NFMLTQPQSVSESPGKTVTISCTRSSGSIGSNFVQWYQQRPGSSPTTVIYEDYQRPSGVPDRFSGSIDSSSNSASLTISGLKTEDEADYYCQSYDADMMVFGGGTKLTVL

SEQ ID NO: 1487 - protein, 126 aa, Artificial Sequence
  Description of Artificial Sequence: Synthetic heavy chain variable region amino acid sequence
QVTLKESGPALVKPTQTLTLTCTFSGFSLNTRGMCVSWVRQPPGKALEWLARIDWDDDKNYSTSLRTRLTISKDTSRNQVVLAMANMDPVDTATYYCARCARYDRSGYYVWYLDSWGQGTLVTVSS

SEQ ID NO: 1488 - protein, 108 aa, Artificial Sequence
  Description of Artificial Sequence: Synthetic light chain variable region amino acid sequence
DIQMTQSPSSLSASVGDRVTITCRASQTIASYLNWYQQKPGKAPKLLIYVASTLQSGVPSRFSGSGSGTDFTLTISSLQPEDFATYYCQQSYSLTQWTFGQGTKVEIK

SEQ ID NO: 1489 - protein, 127 aa, Artificial Sequence
  Description of Artificial Sequence: Synthetic heavy chain variable region amino acid sequence
QVQLVQSGAEVKKPGASVKVSCRASGYTFSSYDINWVRQATGQGLEWMGWMSPNSANTGYAQKFQGRVTMTRDTSINTAYMELSSLSSEDTAVYYCARFLGYCSGGSCYPGYGMDVWGQGTTVTVSS

SEQ ID NO: 1490 - protein, 113 aa, Artificial Sequence
  Description of Artificial Sequence: Synthetic light chain variable region amino acid sequence
EIVLTQSPDSLAVSLGERATINCKSSQNVLYSSNNKDYLSWYQQKPGQPPKLLIYWASTRESGVPDRFSGSGSGTDFTLTINSLQAEDVAVYYCQQYYGTPYTFGQGTKLEIK

SEQ ID NO: 1491 - protein, 130 aa, Artificial Sequence
  Description of Artificial Sequence: Synthetic heavy chain variable region amino acid sequence
QVQLQQWGAGLVKPSETLSLSCDVYGGSFSGYYWTWIRQPPGKGLEWIGEINHSGRTNYNPSLKNRVTISVDTSKKQFSLKLSSVTAADTAVYFCARAPYYDIVTDYNITTAYFYGMDVWGQGTTVTVSS

SEQ ID NO: 1492 - protein, 113 aa, Artificial Sequence
  Description of Artificial Sequence: Synthetic light chain variable region amino acid sequence
DIQMTQSPDSLAVSLGERATINCRSSQSVLYSSNNKNYLTWYQQKPGQPPKLLIYWASTRESEVPDRFSGSGSGTDFSLTISSLQAEDVAVYYCQQYYNTPLTFGGGTKVEIK

SEQ ID NO: 1493 - protein, 127 aa, Artificial Sequence
  Description of Artificial Sequence: Synthetic heavy chain variable region amino acid sequence
QVQLVQSGAEVKKPGASVKVSCTASGYSFTDYDISWVRQAPGQGLEWMGWISAYNGNTNYAQKFQDRVTMNTDTSTNTAYMELRGLRSDDTAVYYCARNCYYGSGTCYIEDYYFDYWGQGTLVTVSS

SEQ ID NO: 1494 - protein, 107 aa, Artificial Sequence
  Description of Artificial Sequence: Synthetic light chain variable region amino acid sequence
DIQMTQSPSSLSASVGDRVTITCRASQDIKNDLGWYQQKPGKPPKRLIYGASRSQSGVPSRFSGSGSGTDFTLTIYSLQPEDFATYYCLQHSDYPFTFGQGTRLEIK

SEQ ID NO: 1495 - protein, 125 aa, Artificial Sequence
  Description of Artificial Sequence: Synthetic heavy chain variable region amino acid sequence
QVQLVESGPGLVRPSGTLSLTCTVSGDSVNSYRWSWIRQSPGKGLEWIGYISYSGETNYNPSLKSRVSISVGTSRYQFFLKLSSVTAADTATYYCARDKTTIFGVSHYYFGVDVWGQGTTVTVSS

SEQ ID NO: 1496 - protein, 112 aa, Artificial Sequence
  Description of Artificial Sequence: Synthetic light chain variable region amino acid sequence
DIVMTQTPLSLPVTPGEPASISCRSSQSLLKSDGYNSLDWYLQRPGQSPQLLIYLGSNRASGVPARFSGSGSGTDFTLKISRVEAEDVGVYYCMQALQTPFTFGPGTKVEIK

SEQ ID NO: 1497 - protein, 123 aa, Artificial Sequence
  Description of Artificial Sequence: Synthetic heavy chain variable region amino acid sequence
QVQLVQSGGGVVQPGRSLRLSCAASGFTFTSYDMHWVRQAPGKGLEWVAIISHDGSKQFYADSVKGRFTISRDNSKNTLYLQMNSLRPEDTAMYYCAKDTPSWGLLAEFFRHWGQGTLVTVSS

SEQ ID NO: 1498 - protein, 113 aa, Artificial Sequence
  Description of Artificial Sequence: Synthetic light chain variable region amino acid sequence
EIVLTQSPDSLAVSLGERATINCKSSQSVLYSSNDKDYLAWYQHKPGQPPKLLIYWASTRESGVPDRFSGSGSGTDFTLTISSLQAEDVAVYYCQQYYGTPYTFGQGTKVEIK

SEQ ID NO: 1499 - protein, 118 aa, Artificial Sequence
  Description of Artificial Sequence: Synthetic heavy chain variable region amino acid sequence
QVQLVQSGAEVKKPGASVKVSCKASGYTFNFYYMHWVRQAPGQGLEWMGWINPKSGGTSYAQKFQGRVIMTGDTSISTTYMELSRLRSDDTAVYYCARADTGLELDVWGQGTTVTVSS

SEQ ID NO: 1500 - protein, 110 aa, Artificial Sequence
  Description of Artificial Sequence: Synthetic light chain variable region amino acid sequence
QSALIQPASVSGSPGQSITISCTGTSSDVGGYNYVSWYQQHPGKAPKLILYDVSKRPSGVSNRFSGSKSGNTASLTISGLQAEDESDYFCSSYTRSNTVVFGGGTKVTVL

SEQ ID NO: 1501 - protein, 125 aa, Artificial Sequence
  Description of Artificial Sequence: Synthetic heavy chain variable region amino acid sequence
EVQLVESGGGLVKPGGSLRLSCAASGFSFSSYNMNWVRQAPGKGLEWVSSISGGSSFVNYADSVKGRFTISRDNAKNSLYLQMSSLKAEDTAIYYCARDPVYCSAASCSAYFDSWGQGSLVTVSS

SEQ ID NO: 1502 - protein, 113 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLIYGNNNRPSGVPDRFSGFKSGSSASLAITGLQAEDEADYYCQSYDIGLSDSHVVFGGGTQLTVL

SEQ ID NO: 1503 - protein, 130 aa, Artificial Sequence
  Description of Artificial Sequence: Synthetic heavy chain variable region amino acid sequence
QVQLQQWGAGPLKSSETLSLTCEVYGGPFSGYSWSWIRQPPGKGLEWIGEINHSGSTNYNPSLKSRVSFSVDTSKNQFSLKLSSVTAADTAVYYCARGAGFCTSTSCPPGLYYYYGMDVWGHGTTVTVSS

SEQ ID NO: 1504 - protein, 106 aa, Artificial Sequence
  Description of Artificial Sequence: Synthetic light chain variable region amino acid sequence
SYELTQPLSVSVALGQTARITCGGNNIESKNVHWYQQMPGLAPVMVIYRDTNRPSGIPERFSGSNSGNTATLTISRAQAGDEADYYCQVWDSGTVIFGGGTKLTVL

SEQ ID NO: 1505 - protein, 116 aa, Artificial Sequence
  Description of Artificial Sequence: Synthetic heavy chain variable region amino acid sequence
EVQLVESGGGVVQPGRSLRLSCAASGFTFSSYGMHWVRQAPGKGLEWVAVISYDGSFIKYADSMMGRFTISRDNSKNTLYLQMSSLRPEDTATYYCAKDALIPEYWGQGTLVTVSS

SEQ ID NO: 1506 - protein, 110 aa, Artificial Sequence
  Description of Artificial Sequence: Synthetic light chain variable region amino acid sequence
QPVLTQPASVSGSPGQSITISCTGTSSDVGGYNYVSWYQKHPDKAPRVIIYEVSNRPSGVSNRFSGSKSGNTASLTISGLQAEDEADYYCCSYTSTSGVVFGGGTKLTVL

SEQ ID NO: 1507 - protein, 124 aa, Artificial Sequence
  Description of Artificial Sequence: Synthetic heavy chain variable region amino acid sequence
QVQLVQSGADVKKPGSSVKISCKASGGSFITNSLSWVRRAPGQGLEWMGGIIPVSGTTTYAQKFLGRVTFTADESTSTAYMELNSLRSEDTAVYYCARFLGTPYPNVHYGMDVWGQGTTVTVSS

SEQ ID NO: 1508 - protein, 107 aa, Artificial Sequence
  Description of Artificial Sequence: Synthetic light chain variable region amino acid sequence
DIRVTQSPSSLSASVGARVTITCRASQSISTYLNWYQEKPGKAPKLLIYAASSLQRGVPSRFSGSGSETTFTLTISSLQPEDFATYYCQQSYTAAYNFGQGTKVEIK

SEQ ID NO: 1509 - protein, 123 aa, Artificial Sequence
  Description of Artificial Sequence: Synthetic heavy chain variable region amino acid sequence
QVQLVQSGAEVKKPGSSVKVSCKASGGTFSSYAISWVRQAPGQGLEWMGRIIPVLDITNYAQKFQGRVTIMADKSTSTAYMELSSLRSEDTAIYYCARETSNFYFYYNAMDVWGQGTTVTVSS

SEQ ID NO: 1510 - protein, 111 aa, Artificial Sequence
  Description of Artificial Sequence: Synthetic light chain variable region amino acid sequence
QPVLTQPPSASGSPGQSVTISCTGTSSDVGGDNYVSWYQQHPGKAPKLLIYEVSKRPSGVPDRFSGSRSGHTASLTVSGLQAEDEADYYCSSYAGRNNLGVFGGGTKLTVL

SEQ ID NO: 1511 - protein, 127 aa, Artificial Sequence
  Description of Artificial Sequence: Synthetic heavy chain variable region amino acid sequence
QVQLVQSGPGLVKPSQTLSLTCAISGDSVSSNSAAWSWIRQSPSRGLEWLGRTYYRSKWYYDHAVSVEGRITINADTSKNHFSLQLNSVTPEDTAVYYCARDPDSGNYFHYYGMDVWGQGTTVTVSS

SEQ ID NO: 1512 - protein, 108 aa, Artificial Sequence
  Description of Artificial Sequence: Synthetic light chain variable region amino acid sequence
ETTLTQSPATLSLSPGERATLSCRTSQSVSSYLAWYQQKPGQAPRLLIYDASRRATGIPARFSGSGSGTHFTLTITSLEPEDFAVYYCQQRSKWPPYSFGQGTKVDIK

SEQ ID NO: 1513 - protein, 125 aa, Artificial Sequence
  Description of Artificial Sequence: Synthetic heavy chain variable region amino acid sequence
QVQLVQSGAEVKRPGASVKVSCKISGYTFTSHYIHWLRQAPGQGLEWMGWINPNTGDTKYEQKFQGRVTMTRDTSLSTAYMELRRLRSDDTAVYYCARDSFYAANGYYFVWFDPWGQGALVTVSS

SEQ ID NO: 1514 - protein, 107 aa, Artificial Sequence
  Description of Artificial Sequence: Synthetic light chain variable region amino acid sequence
DIQMTQSPTSLSASVGDRVTITCRASQSISSYLNWYQQKPGKAPRFLIYAASSLQSGVPSRFRGSGSGTDFTLTISSLQPEDFATYYCQQSYSSPYTFGQGTKVEIK

SEQ ID NO: 1515 - protein, 127 aa, Artificial Sequence
  Description of Artificial Sequence: Synthetic heavy chain variable region amino acid sequence
QVQLQESGPGLVKPSQTLSLTCAISGDSVSSNSAAWNWIRQSPSRGLEWLGRTYYRSKWWTDYAVSVKSRITINPDTSKNQFSLQLNSVTPEDTAVYYCARDPDSGNYFHYYGMDVWGQGTTVTVSS

SEQ ID NO: 1516 - protein, 108 aa, Artificial Sequence
  Description of Artificial Sequence: Synthetic light chain variable region amino acid sequence
ETTLTQSPATLSLSPGERATLSCRASQSASSYLAWYQQKPGQAPRLLIYDASKRATGIPARFSGSGSGTDFSLTISSLEPEDFAVYYCQLRSKWPPYTFGQGTKVEIK

SEQ ID NO: 1517 - protein, 121 aa, Artificial Sequence
  Description of Artificial Sequence: Synthetic heavy chain variable region amino acid sequence
EVQLLESGGGLVQPGGSLRLSCATSGFRFTRYWMHWVRQAPGKGLEWVARINFDGTTTNYADSVKGRFTVSRDNAKNTLYLQINSLRAEDTAVYFCARDQTFLEWLPFESWGQGTLVTVSS

SEQ ID NO: 1518 - protein, 109 aa, Artificial Sequence
  Description of Artificial Sequence: Synthetic light chain variable region amino acid sequence
QTVVTQEPSFSVSPGGTVTLTCGLTSGSVSTSYYPSWYQQTPGQAPRTLIYNTKTRFSGVPDRFSGSILGNKAALTITGAQADDESDYYCVLYMSGGMVFGGGTKLTVL

SEQ ID NO: 1519 - protein, 129 aa, Artificial Sequence
  Description of Artificial Sequence: Synthetic heavy chain variable region amino acid sequence
QVQLVQSGAEVKKPGASVRVSCKASGYPFISYYIHWVRQAPGQGLEWMGMINTNGGSTHYAQKFQGRVTMTRDTSTTTIYMELSRLKSEDTAYYFCARDNTETVLHGFWSGYGSYLDYWGQGTLVTVSS

SEQ ID NO: 1520 - protein, 108 aa, Artificial Sequence
  Description of Artificial Sequence: Synthetic light chain variable region amino acid sequence
EIVLTQSPGTLSLSPGGRATLSCRASQSVTSSYLAWYQQRPGQAPRLLIYGASSRAAGIPDRFSGSGSGTDFTLTISRLEPEDFAVYYCQQYGSAPLTFGGGTKLEIK

SEQ ID NO: 1521 - protein, 119 aa, Artificial Sequence
  Description of Artificial Sequence: Synthetic heavy chain variable region amino acid sequence
QVQLVQSGAEVKKPGESLKISCKGSGYSFISYWIGWVRQMPGKGLEWMGIIYPADSDTRYSPSFQGQVTISVDKSISTAYLQWSSLKASDTGMYYCVRYGVGGTAPRYWGQGTTVTVSS

SEQ ID NO: 1522 - protein, 111 aa, Artificial Sequence
  Description of Artificial Sequence: Synthetic light chain variable region amino acid sequence
NFMLTQPHSVSESPGKTVTISCTGSSGSIASNYVHWYQQRPGSAPTTVIYEDNQRPSGVPDRFSGSIDSSSNSASLTISGLKTEDEADYYCQSYDISNLWVFGGGTKLTVL

SEQ ID NO: 1523 - protein, 125 aa, Artificial Sequence
  Description of Artificial Sequence: Synthetic heavy chain variable region amino acid sequence
EVQLLESGPGLVRPSGTLSLTCTVSGDSISGSNWWAWVRQPPGRRLEWIGEIYYRGATDYNSSLKSRVIISVDNSKNQFSLNLRSVTAADTAIYYCARVEKFATSGYYISYFDYWGQGTLVTVSS

SEQ ID NO: 1524 - protein, 107 aa, Artificial Sequence
  Description of Artificial Sequence: Synthetic light chain variable region amino acid sequence
DIRVTQSPSSLSASVGDRVTITCRASQSISTYLNWYQHNPGKAPKLLIYAASSLQSGVPSRFSGSGSGTHFTLTISSLQPADFSTYYCQQSYSSPWTFGQGTKVEIK

SEQ ID NO: 1525 - protein, 123 aa, Artificial Sequence
  Description of Artificial Sequence: Synthetic heavy chain variable region amino acid sequence
QVQLVESGPGLVKPSETLSLACSVSGVSISTYYWTWIRQPPGKGLEWIGYISYSGSTNYNPSLKSRVTISADTSKNQFSLRLNSVTAADTAVYYCARTYYDFWSTYYGEFDHWGHGTLVTVSS

SEQ ID NO: 1526 - protein, 108 aa, Artificial Sequence
  Description of Artificial Sequence: Synthetic light chain variable region amino acid sequence
SYELTQPLSVSVALGQTARITCGGNNIESKNVHWYQQKPGQAPVVVMYRDTNRPSGIPERFSGSNSGNTATLTISRAQAGDEADYYCQVWDSGTAGVVFGGGTKVTVL

SEQ ID NO: 1527 - protein, 133 aa, Artificial Sequence
  Description of Artificial Sequence: Synthetic heavy chain variable region amino acid sequence
QVQLVQSGAEVKKPGSSVKVSCKASGGTFGSYTINWVRQAPGQGLEWMGGIIPIFGATNYAQNFQGRVSITADKSTATAYMDLISLRSEDTAVYYCARLGRSSPLNSCTTTSCYFWGRGMDVWGQGTTVTVSS

SEQ ID NO: 1528 - protein, 111 aa, Artificial Sequence
  Description of Artificial Sequence: Synthetic light chain variable region amino acid sequence
QSVLIQPASVSGSPGQSITISCTGTISDVGIYNYVSWYQQHPGKAPKLIISDVSDRPSGVSNRFSGSKSGITASLTITGLQAEDEADYYCSSYSSSSTLYVFGTGTKLTVL

SEQ ID NO: 1529 - protein, 129 aa, Artificial Sequence
  Description of Artificial Sequence: Synthetic heavy chain variable region amino acid sequence
EVQLVESGPGLVKPSEALSLTCTVSGASISSYYWTWIRQSPRKGLEWIGYIYHTGRTNYNPSLKRRVTMSVDWSKNQFSLTLSSVTAADTAVYYCARLKVVPAALESAILEHHFGLDVWGQGTTVTVSS

SEQ ID NO: 1530 - protein, 107 aa, Artificial Sequence
  Description of Artificial Sequence: Synthetic light chain variable region amino acid sequence
DIVMTQTPSTLSASIGDRVTLTCRASQSINRWLAWYQQKPGKAPKLLIYKASTLESGVPSRFSGSGSGTEFTLTISGLQPDDFATYYCQQYNNFPYTFGPGTKVDIK

SEQ ID NO: 1531 - protein, 119 aa, Artificial Sequence
  Description of Artificial Sequence: Synthetic heavy chain variable region amino acid sequence
EVQLLESGPGLVRPSETLSLTCTVSGGSLDSGPHYWNWIRQPPGKGLEWIGYIYYSVSTNYNPSLKSRVTISMDTSKNQFSLNLTSVTAADTAVYYCASFQLIYGPQIWGQGKKVTVSS

SEQ ID NO: 1532 - protein, 107 aa, Artificial Sequence
  Description of Artificial Sequence: Synthetic light chain variable region amino acid sequence
DIVLTQSPSSVSASVGDRVTITCRASQAISSWLIWSQHKPGKAPKVLIYAASSLQSGVPSRFSGSGSGTDFTLTISSLQPEDFATYYCQQANNFPLTFGGGTKVEIK

SEQ ID NO: 1533 - protein, 118 aa, Artificial Sequence
  Description of Artificial Sequence: Synthetic heavy chain variable region amino acid sequence
QVQLQQWGAGLLKPSETLSLTCSVYGGSFSGYYWSWIRQPPGKGLEWIGEINHSGSTNYNPSLKSRITISVDTSKNQFSLKLNSVTAADTAVYYCARGDYAFVTFDYWGQGTLVTVSS

SEQ ID NO: 1534 - protein, 110 aa, Artificial Sequence
  Description of Artificial Sequence: Synthetic light chain variable region amino acid sequence
QSVLTQPASVSGSPGQSITISCTGTSSDVGGYNYVSWYQQHPGKAPKLMIYEVSNRPSGVSNRFSGSKSGNTASLTISGLQAEDEADYYCSSYTSSSTPVFGGGTKLTVL

SEQ ID NO: 1535 - protein, 130 aa, Artificial Sequence
  Description of Artificial Sequence: Synthetic heavy chain variable region amino acid sequence
QVQLVESGGGLVKPGGSLRLSCAASGFTFSTYTMNWVRQAPGKGLEWVSSISGSSAYIYYADSVKGRFTISRDNAKNSLFLQMNSLRAEDTAVYYCARLQGLVLPAVMPSYYYYSGMDVWGQGTTVTVSS

SEQ ID NO: 1536 - protein, 112 aa, Artificial Sequence
  Description of Artificial Sequence: Synthetic light chain variable region amino acid sequence
EIVMTQSPLSLPVTPGEPASISCRSSQSLLHSNGYNYLDWYLQKPGQSPQLLIYLASNRASGVPDRFSGSGSGTDFTLKISRVEAEDVGVYYCMQALQTPQAFGQGTKVEIK

SEQ ID NO: 1537 - protein, 118 aa, Artificial Sequence
  Description of Artificial Sequence: Synthetic heavy chain variable region amino acid sequence
EVQLVESGPGLVKPSETLSLTCTVSGGSINSDYWNWIRQTPGKGLEWIGYIFYSGNTNYNPSLKSRVTISIDTSKKKFSLQVTSVTAADTAVYYCARMGTLKFDFDNWGQGTLVTVSS

SEQ ID NO: 1538 - protein, 111 aa, Artificial Sequence
  Description of Artificial Sequence: Synthetic light chain variable region amino acid sequence
QSALTQPRSVSGSPGQSVTIPCTGTSSDVGAYKYVSWYQQHPGKAPKLIIYDVTKRPSGVPNRFSGSKSGNTASLTISGLQAEDEADYYCCSYAGTHTYWVFGGGTKVTVL

SEQ ID NO: 1539 - protein, 121 aa, Artificial Sequence
  Description of Artificial Sequence: Synthetic heavy chain variable region amino acid sequence
EVQLVESGGGVVQPGRSLRLSCAASGFNFHNYAFHWVRQAPGKGLDWVAVTSYDGSSAFYADSVKGRFTISRDNSKKILYLQMTSLRAEDTALYYCARGSSSWSGDYFDYWGQGILVTVSS

SEQ ID NO: 1540 - protein, 108 aa, Artificial Sequence
  Description of Artificial Sequence: Synthetic light chain variable region amino acid sequence
DIVMTQSPVTLSVSPGERATLSCRASQSVGSNLAWYQQKHGQTPRLLIYDASTRATSIPARFSGSGSGTEFTLTISSLQSEDFAVYYCQQYNKWPSYTFGQGTKVEIK

SEQ ID NO: 1541 - protein, 129 aa, Artificial Sequence
  Description of Artificial Sequence: Synthetic heavy chain variable region amino acid sequence
EVQLLESGGGLVQPGGSLRLSCAASGFTFSSYSMNWVRQAPGKGLEWVSYMSSDRSAIYYSDSVKDRFTISRDNAKNSLYLQMHSLRAEDTAVYYCARRYCSSTSCYRGLGYYYGMDVWGQGTTVTVSS

SEQ ID NO: 1542 - protein, 108 aa, Artificial Sequence
  Description of Artificial Sequence: Synthetic light chain variable region amino acid sequence
SYELTQPPSVSVAPGQTARITCGGSNIGNKDVHWYQQKPGQAPVLVVYDDSDRPSGIPERFAGSNSGNTATLTISRVEAGDEADYYCQVWHSAGDHVVFGGGTKLTVL

SEQ ID NO: 1543 - protein, 128 aa, Artificial Sequence
  Description of Artificial Sequence: Synthetic heavy chain variable region amino acid sequence
QVQLVQSGAEVRKPGSSVKVSCKASGGTFNSFVISWVRQAPGQGLEWMGRIIPILATVDYAQKFQGRVTITADKSTTTAYMELSGLTSEDTAVYYCARDPPRWDTTMADYYYQGMDVWGQGTTVTVSS

SEQ ID NO: 1544 - protein, 107 aa, Artificial Sequence
  Description of Artificial Sequence: Synthetic light chain variable region amino acid sequence
DIRVTQSPASLSAFVGDRVTISCRASQSIGSFLNWYQQKPGKAPKLLIYAASSLQSGVPSRFSGSGSGTDFTLAISSLQPEDFATYYCQQSYRSTPTFGGGTKVEIK

SEQ ID NO: 1545 - protein, 124 aa, Artificial Sequence
  Description of Artificial Sequence: Synthetic heavy chain variable region amino acid sequence
QVQLVQSGAEVKKPGESLKISCKGSGYSFTKYWIGWVRQLPGKGLEWMGIIYPGDSETIYSPSFQGQVTISADKSVSTAYLQWSSLKASDTAMYYCARQTFVFWGESHDAFDIWGQGTTVTVSS

SEQ ID NO: 1546 - protein, 110 aa, Artificial Sequence
  Description of Artificial Sequence: Synthetic light chain variable region amino acid sequence
QPVLTQPPSASGSPGQSVTISCTGTSSDVGAHNYVSWYQQHPGKAPKLMIYEVSKRPSGVPDRFSGSKSGNTASLTVSGLQAEDEADYYCSSYAGSNNWVFGGGTKLTVL

SEQ ID NO: 1547 - protein, 121 aa, Artificial Sequence
  Description of Artificial Sequence: Synthetic heavy chain variable region amino acid sequence
EVQLVESGGGLVQPGRSLRLSCTTSGFTFGDYAVTWVRQAPGKGLEWIGIMKSKTYRGTTDYAASLRGRFSISRDDSKSIAYLQMTSLKSEDTGVYYCVRGHDYGDPFDYWGQGTLVTVSS

SEQ ID NO: 1548 - protein, 110 aa, Artificial Sequence
  Description of Artificial Sequence: Synthetic light chain variable region amino acid sequence
QSVLTQPASVSGSPGQSITISCTGGSSDVGYYNYVSWYQQHPGKAPKLLIYDVNNRPSGVSDRFSGSKSGNTASLTISGLQPEDEADYYCSSYTRSRTWVFGGGTKLTVL

SEQ ID NO: 1549 - protein, 124 aa, Artificial Sequence
  Description of Artificial Sequence: Synthetic heavy chain variable region amino acid sequence
QVQLVQSGGGLVEPGGSLRLSCAASGFTFSNTWMNWVRQAPGKGLTWVGRIKRKTDFGTSDYAAPVKGRFTISRDDSKNMVFLQMNSLKIEDTGVYYCTTHPRPYLDTTAVVYWGQGTLVTVSS

SEQ ID NO: 1550 - protein, 111 aa, Artificial Sequence
  Description of Artificial Sequence: Synthetic light chain variable region amino acid sequence
QPVLTQPHSVSESPGKTVTISCIGSSGSITSNYVQWFQQRPGSAPTTVIYEDDQRPSGVPDRFSGSIDSSSNSASLTISGLKTEDEADYYCQSYHHTNPWVFGGGTKLTVL

SEQ ID NO: 1551 - protein, 126 aa, Artificial Sequence
  Description of Artificial Sequence: Synthetic heavy chain variable region amino acid sequence
QVQLVQSGAEVKKPGASVKVSCKASGYTFTSDDINWVRQATGQGLEWMGWMNPNSGDTGYAQKFQGRVTMTRDTSISTAYMELSSLRSEDTAVYYCARVRIQCSGGRCSYWFFDLWGRGTLVTVSS

SEQ ID NO: 1552 - protein, 110 aa, Artificial Sequence
  Description of Artificial Sequence: Synthetic light chain variable region amino acid sequence
QSALTQPASVSGSPGQSITISCIGTSSDVGNYNLVSWYQHHPGKAPKVMIYEVNERPSGVSNRFSGSKSGNTASLTISGLQAEDEADYYCCSYAGRSTWVFGGGTKLTVL

SEQ ID NO: 1553 - protein, 124 aa, Artificial Sequence
  Description of Artificial Sequence: Synthetic heavy chain variable region amino acid sequence
QVQLVESGGGVVQPGRSLRLSCAASGFTFSNHAMHWVRQAPGKGLEWLSFISYDGGVNFYRDSVKGRFTISRDNSKNTLYLQMSSLRPEDTAVYYCARDRVGRVVGASYYLDYWGRGALVTVSS

SEQ ID NO: 1554 - protein, 109 aa, Artificial Sequence
  Description of Artificial Sequence: Synthetic light chain variable region amino acid sequence
QSVVTQPPSVSVAPGQTASITCGGKHIGSKSVHWYQQKPGQSPVLVVHDDSDRPSGILERFSGSNSGNTATLTINRVEAGDEADYYCQVWDNASDHPYVFGPGTKVTVL

SEQ ID NO: 1555 - protein, 125 aa, Artificial Sequence
  Description of Artificial Sequence: Synthetic heavy chain variable region amino acid sequence
EVQLLESGGGLVKPGGSLRLSCAASGFIFSDYAMNWVRQTPGKGLEWVSSISDSSAYKYYTGSVSGRFTISRDNAKNSLYLQMNDLRPEDTAVFYCARGQWRCSGASCYSPFDSWGQGTLVTVSS

SEQ ID NO: 1556 - protein, 109 aa, Artificial Sequence
  Description of Artificial Sequence: Synthetic light chain variable region amino acid sequence
SYELTQPPSVSVAPGQTARIPCGGNNIESKNVHWYQQKPGQAPVLVVYDDSDRPSGIPERFSGSNSGSTATLTISRVEAGDEADYYCHVWHRSGDLREVFGSGTKVTVL

SEQ ID NO: 1557 - protein, 121 aa, Artificial Sequence
  Description of Artificial Sequence: Synthetic heavy chain variable region amino acid sequence
EVQLVESGGVVVQPGGSLRLSCAASGFSFDDYTMYWVRQAPEKGLEWISLISWNGGVTYYPDSVKGRFTVSRDNNKNSLYLQMDSLRPEDSAFYYCAKESLESSGHFLDYWGQGTLVTVSS

SEQ ID NO: 1558 - protein, 111 aa, Artificial Sequence
  Description of Artificial Sequence: Synthetic light chain variable region amino acid sequence
QPVLTQSRSVSGSPGQSVTISCIGTNSDVGGYHYVSWFQHHPGKAPKLMIYDVSRRPSGVPARFSGSKSGNTASLSISGLRAEDEADYYCCSFAGTYTPYVFGTGTKLTVL

SEQ ID NO: 1559 - protein, 121 aa, Artificial Sequence
  Description of Artificial Sequence: Synthetic heavy chain variable region amino acid sequence
QVQLVQSGAEVKKPGSSVKVSCKASGGIFSDFAISWVRQAPGQGLEWMGGIITIIGTPEYAQKFQGRVRITADESTTTVFMELSRLTSEDTAVYYCARDSRYGSGWYWDHWGQGTLVTVSS

SEQ ID NO: 1560 - protein, 113 aa, Artificial Sequence
  Description of Artificial Sequence: Synthetic light chain variable region amino acid sequence
DIVMTQTPDSLAVSLGERATINCKSSQSVLYISNNKNYLAWYQQKPGQPPKLLIYWASTRDSGVPDRFSGSGSGTDFTLSISSLQPEDVAVYYCQQYYDTPRTFGQGTKLEIK

SEQ ID NO: 1561 - protein, 124 aa, Artificial Sequence
  Description of Artificial Sequence: Synthetic heavy chain variable region amino acid sequence
QVQLVQSGAEVKKPGSSVKVSCKASGGPFSSDAMSWVRQAPGQGLEWMGGIIPILGSATYAQKFKGRVTIAADESTSTSYMELSGLKYEDTAVYYCARPFYDPLTGYFDTFNVWGQGTTVTVSS

SEQ ID NO: 1562 - protein, 111 aa, Artificial Sequence
  Description of Artificial Sequence: Synthetic light chain variable region amino acid sequence
QSVLTQPRSVPGSPGQSVTISCTGTSGDVGGYNYVSWYQQHPGKAPKLVIYDVTKRPSGVPDRFSGSKSGNRASLTISGLQAEDEADYYCCSYAGSQTGYVFGTGTKVTVL

SEQ ID NO: 1563 - protein, 123 aa, Artificial Sequence
  Description of Artificial Sequence: Synthetic heavy chain variable region amino acid sequence
EVQLLESGGGLVQPGGSLRLSCAASGFTFSDFPLSWVRQAPGKGLVWVSAISSSGGDTYYADSVKGRFTISRDSSKNALYLQMNSLRAEDTAVYYCAKGQELLRPYYYGMDVWGQGTTVTVSS

SEQ ID NO: 1564 - protein, 110 aa, Artificial Sequence
  Description of Artificial Sequence: Synthetic light chain variable region amino acid sequence
QSALIQPASVSGSPGQSITISCTGTSSDVGGYNFVSWYQQHPGKAPKLMIFEVSNRPSGVSHRFSGSKSGNTASLTISGLQAEDEADYYCSSCTSRFTYVFGTGTKLTVL

SEQ ID NO: 1565 - protein, 124 aa, Artificial Sequence
  Description of Artificial Sequence: Synthetic heavy chain variable region amino acid sequence
EVQLLESGPGLLKTSETLSLTCTVSDGSISGYYWTWIRQPPGKGLECIGYISYSGSTNYSPSLKSRVTISVDTSKNQFSLKLSSVTAADTAVYYCAKIGGYCNPTKCYGWFDPWGQGTLVTVSS

SEQ ID NO: 1566 - protein, 111 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIFGNTNRPSGVPDRFSGSKSGTSASLAITGLQAEDEAAYYCQSYDSSLFYVVLGGGTKLTVL

SEQ ID NO: 1567 - protein, 132 aa, Artificial Sequence
  Description of Artificial Sequence: Synthetic heavy chain variable region amino acid sequence
QVQLQQSGAGLLKPSETLSLTYVVYGGSFSGYYWSWIRQPPGKGLEWVGDINHSTTTNYNPSLESRITISIDTSKNQFSLNLSSVTAADSAVYYCARGPKECTSSSCDRFGVDYFYYGMDVWGRGTTVTVSS

SEQ ID NO: 1568 - protein, 111 aa, Artificial Sequence
  Description of Artificial Sequence: Synthetic light chain variable region amino acid sequence
QSVLTQPPSVSGAPGQRVTISCTGSSANIGAGYDVHWYQQFPGTAPKLLIFGNSNRPSGVPDRFSGSKSGTSASLAITGLQAGDEADYYCQSYDGTLGGWVFGGGTQLTVL

SEQ ID NO: 1569 - protein, 124 aa, Artificial Sequence
  Description of Artificial Sequence: Synthetic heavy chain variable region amino acid sequence
QVTLKESGPTLVKPTQTLRLTCTFSGFSLNVISGVGVGWIRQPPGKALEWLALIYWDDDKRYSPSLKSRLTIAKDTSKNQVVLTMTNMDPVDTATYYCAHKGGSIEAAVGFDYWGQGTLVTVSS

SEQ ID NO: 1570 - protein, 112 aa, Artificial Sequence
  Description of Artificial Sequence: Synthetic light chain variable region amino acid sequence
QSVLTQPPSVSGAPGQRVIISCTGSSSNIGAGFAVHWYQQLPGTAPKLLIYANTNRPSGVPDRFSGSKSGTSASLAITGLQAEDEADYYCQSYDTSLSGFYVFGTGTKLTVL

SEQ ID NO: 1571 - protein, 123 aa, Artificial Sequence
  Description of Artificial Sequence: Synthetic heavy chain variable region amino acid sequence
QVQLVQSGAEVRKPGASVKVSCKASGYGFRSYDLTWVRQAPGKGLEWVGWISAYSGGTNYAQTLQGRVTMTTDTSTSTAYMELRSLGPDDTAVYYCARAGLYGSGSPDGFDSWGQGTLVTVSS

SEQ ID NO: 1572 - protein, 107 aa, Artificial Sequence
  Description of Artificial Sequence: Synthetic light chain variable region amino acid sequence
SYELTQPPSVSVSPGQTASITCSGDKLGDKYASWYQQRPGQSPVLVISQDTKRPSGIPERFSGSTSGNTAILTISGTQAMDEADYYCLAWDSSTAWVFGGGTKLTVL

SEQ ID NO: 1573 - protein, 124 aa, Artificial Sequence
  Description of Artificial Sequence: Synthetic heavy chain variable region amino acid sequence
QVQLVESGGGLVQPGGSLRLSCAASGFTFSDYAMSWVRQAPGKGLVWVSSISGSGKFTYYEDSLRGRVTISRDNSKNTVYLHMNSLRTEDTALYYCARLRIPVINEVDGAMDVWGQGTTVTVSS

SEQ ID NO: 1574 - protein, 108 aa, Artificial Sequence
  Description of Artificial Sequence: Synthetic light chain variable region amino acid sequence
SYELTQLPSVSVSPGQTARITCSGDALPKKFAYWYQQKSGQAPVLVIYEDTGRPSGIPERFSGSTSGTTATLTINGAQVEDEGDYYCYSADSSDNQGVFGGGTKVTVL

SEQ ID NO: 1575 - protein, 125 aa, Artificial Sequence
  Description of Artificial Sequence: Synthetic heavy chain variable region amino acid sequence
EVQLLESGPRLVKPSETLSLTCIVSGGFISYDYWSWIRQPAGKGLEWIGRIYAGGIPKYNPSLKSRVTMSLDMSNNQFSLRLKSVTAADSAVYYCARAEPCSGDCFLGENPFDSWGQGTLVTVSS

SEQ ID NO: 1576 - protein, 110 aa, Artificial Sequence
  Description of Artificial Sequence: Synthetic light chain variable region amino acid sequence
QSVLTQPPSASGTPGQRVTISCSGSSSSIGSNYVYWYQQLPGTAPKLLIHKDNERPSGVPDRFSGSKSGTSASLAISGLRSEDEGDYSCAAWDDSLSGWVFGGGTKLTVL

SEQ ID NO: 1577 - protein, 119 aa, Artificial Sequence
  Description of Artificial Sequence: Synthetic heavy chain variable region amino acid sequence
QVQLVQSGGGLVQPGGSLRLACAASGFTLSGYAMNWVRQAPGKGLEWVSSISGSGGSTYYADSVKGRFTTSRDNSKNTVFLHMNSLRAEDTAIYYCATVPWETGPFDHWGQGTLVTVSS

SEQ ID NO: 1578 - protein, 111 aa, Artificial Sequence
  Description of Artificial Sequence: Synthetic light chain variable region amino acid sequence
QSVLTQPPSVSGAPGQRVTISCTGSSSNIGAGYAVHWYQQLPGTAPKLLIHGTTNRPSGVPDRFSGSKSGTSASLAITGLQAEDEADYYCQSYDSRLSGYVFGTGTKLTVL

SEQ ID NO: 1579 - protein, 125 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISSSSSYINYADSVKGRFTISRDNAKNSLYLQMNSLRAEDTALYYCARDLGYCSDTSCTPGIGYWGQGTLVTVSS

SEQ ID NO: 1580 - protein, 111 aa, Artificial Sequence
  Description of Artificial Sequence: Synthetic light chain variable region amino acid sequence
QPVLTQPPSVSGAPGQRVTISCTGSSSNIGAGYDVHWYQQLPGTAPKLLIYGNSNRPSGVPDRFSGSKSGTSASLAITGLQAEDEADYYCQSYDSGLSPWVFGGGTKLTVL

SEQ ID NO: 1581 - protein, 127 aa, Artificial Sequence
  Description of Artificial Sequence: Synthetic heavy chain variable region amino acid sequence
QVQLVESGPGLVKPSETLSLTCNVSGGSIITSGSYWGWIRQPPGKGLTWIGSISYSGTTYYNPSLRSRLTISLDTSRNHFSLQLTSVSAADTAVYYCARAFYEVWTGSEIPGDFDRWGQGTLVTVSS

SEQ ID NO: 1582 - protein, 108 aa, Artificial Sequence
  Description of Artificial Sequence: Synthetic light chain variable region amino acid sequence
EIVLTQSPGTLSLSPGERATLSCRASQSVSSSYLAWYQQKPGQAPRLLIYGASSRAIDIPDRFSGSGSGTDFTLTISRLEPEDFAVYYCQQFRRSPWTFGQGTKVDIK

SEQ ID NO: 1583 - protein, 127 aa, Artificial Sequence
  Description of Artificial Sequence: Synthetic heavy chain variable region amino acid sequence
EVQLLESGGGVVRPGGSLRLSCAASGFSFDDYGMTWVRQAPGKGLEWVSGINWNGISTDYADSVKGRFTISRDNAKNSVYLQMNSLRAEDTALYYCARIGGVVVIASTAYYYGMDVWGQGTTVTVSS

SEQ ID NO: 1584 - protein, 107 aa, Artificial Sequence
  Description of Artificial Sequence: Synthetic light chain variable region amino acid sequence
DIQLTQSPSSLSAYVGDRVTITCRASQSIRNHLNWYQQKPGKAPQLLIYTASSLQDGVPSRFSGSGSGTDFTLAISSLQPEDFATYYCQQSHSMPPTFGQGTRLEIK

SEQ ID NO: 1585 - protein, 123 aa, Artificial Sequence
  Description of Artificial Sequence: Synthetic heavy chain variable region amino acid sequence
EVQLVESGGGLVQPGRSLRLSCAASGFTFDDFAMDWVRQVPGKGLEWVSGISWNGVSKDYAGSVKGRFTISRDNAKNSLYLQMNSLRAEDTALYFCAKARRDVYNWGDAFDIWGQGTMVTVSS

SEQ ID NO: 1586 - protein, 108 aa, Artificial Sequence
  Description of Artificial Sequence: Synthetic light chain variable region amino acid sequence
DIRLTQSPGTLSLSPGERATLSCRASQPLNSNYLAWYRQKPGQAPRLLIFDASSRATGVPDRISGSGSGTDFTLTVSRLEPEDIAVYYCQQYASSPWTFGLGTKVEIK

SEQ ID NO: 1587 - protein, 124 aa, Artificial Sequence
  Description of Artificial Sequence: Synthetic heavy chain variable region amino acid sequence
QVQLVQSGAEVKKPGSSVKVSCKASGGTFNNFPISWVRQAPGQGLEWMGGIIPMFGRANYAQKFQGRVTITADESTTTVYMALRSLRSEDTAVYYCARPDYDVLTGFEGAFDIWGQGTMVTVSS

SEQ ID NO: 1588 - protein, 110 aa, Artificial Sequence
  Description of Artificial Sequence: Synthetic light chain variable region amino acid sequence
QSALTQPASVSGSPGQLITISCTGTSRDVGGYNYVSWYQQHPGKAPKLMIYDVTNRPSGVSNRFSGSKSGNTASLTISGLQSEDEADYYCSSYTSTTTWVFGGGTKLTVL

SEQ ID NO: 1589 - protein, 128 aa, Artificial Sequence
  Description of Artificial Sequence: Synthetic heavy chain variable region amino acid sequence
QVQLVQSGAEVKKPGESLRISCKGSGDTFSNYWIGWVRQMPGKGLEWMGIIYPGDSDTRYSPSFQGQVTFSADKSISTAYLQWSSLKASDTAMYYCVRQVGGVVVTDTDNYYYGMDVWGQGTTVTVSS

SEQ ID NO: 1590 - protein, 107 aa, Artificial Sequence
  Description of Artificial Sequence: Synthetic light chain variable region amino acid sequence
DIRLTQSPSSLSASVGDRVTITCRASQSIRSYLNWYQQKPGKAPKLLIYSASSLQSGVPSRFSGSGSGTDFTLTISSLQPEDFATYYCQQSHSTPLTFGPGTKVDIK

SEQ ID NO: 1591 - protein, 125 aa, Artificial Sequence
  Description of Artificial Sequence: Synthetic heavy chain variable region amino acid sequence
EVQLVESGGGLVQPGRSLRLSCTGSGFTFGDYAISWFRQAPGKGLEWVGFIRSKPYGGTTEYAASVKGTFTISRDDSKSIAYLQMNSLKTGDTAVYFCTRGIWGITMIVPWSDPWGQGTLVTVSS

SEQ ID NO: 1592 - protein, 112 aa, Artificial Sequence
  Description of Artificial Sequence: Synthetic light chain variable region amino acid sequence
DIVMTQTPLSLPVTPGEPASISCRSSQSLLHSNGFNYLAWYLQKPGQSPQLLIYLNSNRASGVPDRFSGSGSGTDFTLKISRVEAEDVGVYYCMQALQTPLTFGPGTKLEIK

SEQ ID NO: 1593 - protein, 124 aa, Artificial Sequence
  Description of Artificial Sequence: Synthetic heavy chain variable region amino acid sequence
QVQLVQSGAEMKKPGSSVKVSCKASGRTFKYFALNWMRRAPGHGLEWIGGDIPISGSTNYAQKFQGRVTITADESASTAYMEVSRLRSDDTAVYYCASLHYDVSTGFSDAFDIWGQGTMVTVSS

SEQ ID NO: 1594 - protein, 110 aa, Artificial Sequence
  Description of Artificial Sequence: Synthetic light chain variable region amino acid sequence
QSVLTQPASVSGSPGQSITISCTGTSSDVGAYNYVSWYQHHPGKAPKLMIFDVSNRPSGVSNRFSGSKSGNTASLTISGLQAEDEADYYCSSYRSTFSYVFGTGTKVTVL

SEQ ID NO: 1595 - protein, 121 aa, Artificial Sequence
  Description of Artificial Sequence: Synthetic heavy chain variable region amino acid sequence
QVQLVQSGAEVKKPGASVKVSCEASGYTFTDYYMHWVRQAPGQGLEWMGWINPNSGVTKIAQNFQGRVTMTRDTSITTAYMDLSRLRSDDTAVYYCARVVDGDYDNWFDFWGQGTLVTVSS

SEQ ID NO: 1596 - protein, 110 aa, Artificial Sequence
  Description of Artificial Sequence: Synthetic light chain variable region amino acid sequence
SYVLTQPPSASGTPGQRVTISCSGSTSNIGTNTVNWYQQPPGMAPKLLIYANNQRPSGVPDRFSGSKSGTSASLAISGLQSEDEADYHCAVWDDSLPGWVFGGGTKLTVL

SEQ ID NO: 1597 - protein, 131 aa, Artificial Sequence
  Description of Artificial Sequence: Synthetic heavy chain variable region amino acid sequence
EVQLLESGGGLVQPGGSLRLSCAASGFTFTSYWMSWVRQAPGQGLEWVATIKQDGSEKYYVDSVKGRFTISRDNAKNSLYLQMNSLGAEDTAVYYCARDMYCSTTTCYFFETYYYNGMDVWGQGTTVTVSS

SEQ ID NO: 1598 - protein, 107 aa, Artificial Sequence
  Description of Artificial Sequence: Synthetic light chain variable region amino acid sequence
DIRLTQSPSSVSASVGDRVTITCRASQVTSTWLAWYQQNPGKAPKLLIYAASRLQSGVPSRFSGSGSGTEFTLTISSLQPEDFATYYCQQANSFPLTFGGGTKVEIK

SEQ ID NO: 1599 - protein, 124 aa, Artificial Sequence
  Description of Artificial Sequence: Synthetic heavy chain variable region amino acid sequence
EVQLVESGGGVVQPGRSLRLSCAASGFTFSSYAMHWVRQAPGKGLEWVAVISFDGSSDYYADSVKGRFTISRDSSKNTLYLRMNSLRAEDTAVYYCARRAVEYSIYNNDAFDVWGQGTTVTVSS

SEQ ID NO: 1600 - protein, 106 aa, Artificial Sequence
  Description of Artificial Sequence: Synthetic light chain variable region amino acid sequence
SYELTQPPSVSVSPGQTASITCSGDKLGNKFTFWYQQKSGQSPVLVIYQETKRPSGIPERFSGSNSGNTATLTISGTQSMDEADYYCQAWDSSTAFFGGGTKLTVL

SEQ ID NO: 1601 - protein, 124 aa, Artificial Sequence
  Description of Artificial Sequence: Synthetic heavy chain variable region amino acid sequence
EVQLVQSGAEVRRPGSSVKVSCKASGGTLDTDSISWVRQVPGQGLVWVGGVIPILGSVVYARKFQGRVTITADGSTSTAYMELRSLRSEDTAMYYCASQFYDFRRGYFDAFDIWGQGTTVTVSS

SEQ ID NO: 1602 - protein, 110 aa, Artificial Sequence
  Description of Artificial Sequence: Synthetic light chain variable region amino acid sequence
ETTLTQSPGILSLSPGERATLSCRATQTVISNYINWYQQKPGQAPRLLIYGASSRATGIPDRFSGSGSGTDFTLTISRLEPEDFAVYYCQRYDSSPPGFTFGPGTKVDIK

SEQ ID NO: 1603 - protein, 115 aa, Artificial Sequence
  Description of Artificial Sequence: Synthetic heavy chain variable region amino acid sequence
QVQLVESGAEVKKPGASVKVSCRASGYTFSAYDINWVRQAPGQGLEWVGWMNPNSGNTGYALRFQGRVTMTRDTSINTAYMELSSLRSDDTAVYYCAAQLWYPNWGQGTLVTVSS

SEQ ID NO: 1604 - protein, 106 aa, Artificial Sequence
  Description of Artificial Sequence: Synthetic light chain variable region amino acid sequence
SYELTQPPSVSVGLGQTASITCGGNNIGSKSVHWYQQKPGQAPTLVIYRDTNRPSGIPERFSGSNSENTATLTISRAQAGDEADFYCQVSDNYSWVFGGGTKLTVL

SEQ ID NO: 1605 - protein, 126 aa, Artificial Sequence
  Description of Artificial Sequence: Synthetic heavy chain variable region amino acid sequence
EVQLLESGGDLVQPGGSLRLSCAASGFTFFSYALNWVRRTPGKGLEWVSGISGSGGSTYYADSVKGRFTISRDNSKSTLYLQMNSLKVDDTAVYFCAKDFQHDYGDPYRSYYFDHWGQGTLVTVSS

SEQ ID NO: 1606 - protein, 108 aa, Artificial Sequence
  Description of Artificial Sequence: Synthetic light chain variable region amino acid sequence
DIQLTQSPSSLAASVGDRVTITCQASRDIRKSLNWYQVKPGKAPKLLISDASYLETGVPPRFSGSGFGTHFTFTISSLQPEDIATYYCQQYDNLPPPTFGGGTKVDIK

SEQ ID NO: 1607 - protein, 124 aa, Artificial Sequence
  Description of Artificial Sequence: Synthetic heavy chain variable region amino acid sequence
QVQLVQSGAEVKKPGESLKISCKGSGYSFTSSWIGWVRQMPGKGLEWMGIIYPGDSDTRYSPSIQGRVTISADKSITTAYLQWSSLKASDTATYYCAKFGGYADAYFYHGMDVWGQGTTVTVSS

SEQ ID NO: 1608 - protein, 110 aa, Artificial Sequence
  Description of Artificial Sequence: Synthetic light chain variable region amino acid sequence
SYVLTQPPSASGTPGQRVTISCSGSSSNVGSNTVNWYQQLPGTAPKLLIHFNNQRPSGVPDRFSGSKSGTSASLAISGLQSEDEADYYCAAWDDSLNTWVFGGGTKVTVL

SEQ ID NO: 1609 - protein, 124 aa, Artificial Sequence
  Description of Artificial Sequence: Synthetic heavy chain variable region amino acid sequence
QVQLVESGGGVVQPGRSLRLSCAASGFTFSSYAMHWVRQAPGKGLEWLAVISFDGSSEFYGDSVRGRFTISRDNSKNTLYLRVNSLRAEDTALYYCARRSLKYSMYNNDAFDVWGQGTTVTVSS

SEQ ID NO: 1610 - protein, 106 aa, Artificial Sequence
  Description of Artificial Sequence: Synthetic light chain variable region amino acid sequence
QPVLTQPPSVSVSPGQTASITCSGDKLGNKFTFWYQQKSGQSPVLVIYQESQRPSGIPERFSGSNSGNTATLTIRGAQAMDEADYYCQAWDSSTAFFGGGTKLTVL

SEQ ID NO: 1611 - protein, 124 aa, Artificial Sequence
  Description of Artificial Sequence: Synthetic heavy chain variable region amino acid sequence
QVQLVQSGGGVVQPGRSLRLSCAASGFTFSNYAMHWVRQAPGKGLEWVTLISYDGSAQDYADSVKGRITISRDNSKNTLYLQMSSLRPEDTAVYYCARYYCTNDVCSSSALDIWGQGTTVTVSS

SEQ ID NO: 1612 - protein, 106 aa, Artificial Sequence
  Description of Artificial Sequence: Synthetic light chain variable region amino acid sequence
SYELIQPPSVSVSPGQTASITCSGDKLGNKFTCWYQQKPGQSPVLVIYQDSKRPSGIPERFSGSNSGNTATLTISGTQAMDEADYYCQAWDSSTVVFGGRTKLTVL

SEQ ID NO: 1613 - protein, 126 aa, Artificial Sequence
  Description of Artificial Sequence: Synthetic heavy chain variable region amino acid sequence
QVTLKESGPALVKPTQTLTLTCTFSGFSLSTSRMCVSWIRQSPGKALEWLARIDWDDDKFFSTSLKTRLTISKDTSRNQVVLTMTNMDPVDTATYYCARTTVYASGGYYLYYFDYWGQGTLVTVSS

SEQ ID NO: 1614 - protein, 107 aa, Artificial Sequence
  Description of Artificial Sequence: Synthetic light chain variable region amino acid sequence
DIQLTQSPSSLPASVGDRVTITCRASQRIASYLNWYQQKPGKAPKVLIYAASNLQSGVPSRFSGSGSGTDFTLTINSLQPEDFATYYCQQSYTTPWTFGQGTKVEIK

SEQ ID NO: 1615 - protein, 132 aa, Artificial Sequence
  Description of Artificial Sequence: Synthetic heavy chain variable region amino acid sequence
EVQLVESGAGLLKPSETLSLTCVVYGGSFSGYYWSWIRQPPGKGLEWVGDINHSTTTNYNPSLESRITISIDTSKNQFSLNLSSVTAADSAVYYCARGPKECTSSSCDRFGVDYFYYGMDVWGRGTTVTVSS

SEQ ID NO: 1616 - protein, 111 aa, Artificial Sequence
  Description of Artificial Sequence: Synthetic light chain variable region amino acid sequence
QSVLTQPPSVSGAPGQRVTISCTGSSANIGAGYDVHWYQQFPGTAPKLLIFGNSNRPSGVPDRFSGSKSGTSASLAITGLQAEDEADYYCQSYDGTLGGWVFGGGTQLTVL

SEQ ID NO: 1617 - protein, 122 aa, Artificial Sequence
  Description of Artificial Sequence: Synthetic heavy chain variable region amino acid sequence
EVQLLESGGGLVQPGGSLRLSCAASEFTFSRYPMSWVRQAPGKGLEWVSGISVSGDSTYYADSVKGRLTISRDNSKNTLYLQMNSLRAEDTAVYYCAIDHYDTSGYYGMDVWGQGTTVTVSS

SEQ ID NO: 1618 - protein, 112 aa, Artificial Sequence
  Description of Artificial Sequence: Synthetic light chain variable region amino acid sequence
DIRLTQSPLSLPVTPGEPASISCRSSRSLLRSNGYNYLDWYLQKPGQSPQLLIYLGSNRASGVPDRFSGSGSGTDFTLKISRVEAEDVGVYYCMQALQSSYTFGQGTKLEIK

SEQ ID NO: 1619 - protein, 124 aa, Artificial Sequence
  Description of Artificial Sequence: Synthetic heavy chain variable region amino acid sequence
EVQLVESGGGLVKPGGSLRLSCAASGFTLSTYGVNWVRQAPGKGLEWVSSISSSGNNIHYADSVKGRFTVFRDNAKHSMYLQMNSLRAEDTAVYYCARSLDYSNYYYYYGLDVWGQGTTVTVSS

SEQ ID NO: 1620 - protein, 113 aa, Artificial Sequence
  Description of Artificial Sequence: Synthetic light chain variable region amino acid sequence
EIVLTQSPDSLAVSLGERATINCKSSQSIFYSSNNMNYLAWYQQKAGQPPKLLIYWASTRESGVPDRFSGSGSGTDFTLTISSLQAEDVAVYYCHQYYSIPLTFGGGTKVEIK

SEQ ID NO: 1621 - protein, 126 aa, Artificial Sequence
  Description of Artificial Sequence: Synthetic heavy chain variable region amino acid sequence
QVQLVESGAEVKKPGASVKVSCKASGYNFIDYGISWVRQAPGQGLEWVGWISAYNGNTNYAQKLQGRVTMTTDTSTNTAYMELRSLRSDDTALYYCARDSSSLHPTYYYYYPMDVWGQGTTVTVSS

SEQ ID NO: 1622 - protein, 109 aa, Artificial Sequence
  Description of Artificial Sequence: Synthetic light chain variable region amino acid sequence
DIVMTQSPATLSVSPGERATLSCRASQSVSSRLAWYQQKPGQAPRLLIYGASTRATDVPARFSGSGSGTEFTLTISSLQSEDFAVYYCQQYNNWPPERTFGQGTKVEIK

SEQ ID NO: 1623 - protein, 129 aa, Artificial Sequence
  Description of Artificial Sequence: Synthetic heavy chain variable region amino acid sequence
QVQLQQWGAGLLKPSETLSLTCGVYGGSFTGYQWSWIRQSPGKGLEWIGDIDHGGNTNYRPSLKSRIITSVNMSKKEFSLKLASVTAADTAVYYCARGVGFLEFSGGPTGRRRNWFDSWGQGTLVTVSS

SEQ ID NO: 1624 - protein, 108 aa, Artificial Sequence
  Description of Artificial Sequence: Synthetic light chain variable region amino acid sequence
DIQLTQSPGTLSLSPGEGATLSCRASQSVGGSYLAWYQQRPGQAPRLLIYGASNRAADSPDRFSGSGSATDFTLTISRLEPEDFAVYYCQQYGSSPWTFGQGTKVEIK

SEQ ID NO: 1625 - protein, 128 aa, Artificial Sequence
  Description of Artificial Sequence: Synthetic heavy chain variable region amino acid sequence
QITLKESGPTLVKPTQTLTLTCTFSGFSLSSSGVGVGWIRQPPGKALEWLALIYWDDDKRYSPSLKSRLTITKDTSKNQVVLTMTNMDPVDTATYYCAHRGPYYYDMSGYYYEAFDIWGQGTTVTVSS

SEQ ID NO: 1626 - protein, 109 aa, Artificial Sequence
  Description of Artificial Sequence: Synthetic light chain variable region amino acid sequence
SYELMQPPSVSVAPGQTARITCGGNNIGSKGVHWYQQKPGQAPVLVVYDDNDRPSGIPERFSGSNSGNTATLTISRVEAGDEADYYCQVWDSSSDHHYVFGTGTKVTVL

SEQ ID NO: 1627 - protein, 122 aa, Artificial Sequence
  Description of Artificial Sequence: Synthetic heavy chain variable region amino acid sequence
EVQLVESGVAVKKPGESLKISCKGSGYNFDSFWIGWVRQLPGKGLEWMGIIFPGDSDTRYGPSFQGQVTISADKSINTAYLQWRSLKASDTAMYYCARHGLGGYDNSGYNLWGHGTMVTVSS

SEQ ID NO: 1628 - protein, 107 aa, Artificial Sequence
  Description of Artificial Sequence: Synthetic light chain variable region amino acid sequence
DIVMTQSPSSLSASVGDRVTITCQASHDISTSLNWYQQKPGKAPNLLISDASTLERGVPSRFSGGGSGTEFTFTISSLQPEDIATYYCQQFENLPITFGQGTRLEIK

SEQ ID NO: 1629 - protein, 131 aa, Artificial Sequence
  Description of Artificial Sequence: Synthetic heavy chain variable region amino acid sequence
QVQLVQSGAEVKKPGASVRVSCKASGYTLTGYYIHWLRQAPGQGLEWVGRINPNTGETSYSQKFQGRVIMTRDTSVSTAYVDLSRLRSRDTAVYFCARSDVMITVTAEGDFSYYYYRFDVWGQGTTVTVSS

SEQ ID NO: 1630 - protein, 111 aa, Artificial Sequence
  Description of Artificial Sequence: Synthetic light chain variable region amino acid sequence
DIVMTQTPLSLPVTPGEPASISCRSSQSLLHSNGHNYLDWYLQKPGQSPQLLIYLGSIRASGVSDRFSGSGSGTDFTLKISRVEAEDVGIYYCMQALQTPHFGGGTKVEIK

SEQ ID NO: 1631 - protein, 118 aa, Artificial Sequence
  Description of Artificial Sequence: Synthetic heavy chain variable region amino acid sequence
QVQLVQSGAEVKKPGESLKISCKGSGYSFTNYWIGWVRQMPGKGLEWMGIIFPADSDTRYSPSFQGQVTISADKSVSTAYLQWTSLKASDTAIYYCARLGVAAAGGYWGQGTLVTVSS

SEQ ID NO: 1632 - protein, 107 aa, Artificial Sequence
  Description of Artificial Sequence: Synthetic light chain variable region amino acid sequence
DIQVTQSPSSLSASVGDRVTITCQASQDISNYLNWYQQKPGKAPKLLIHDASTLETGVPSRFSGRGSGTDFTFTISSLQPEDIATYYCQQYDNLPPTFGGGTKVEIK

SEQ ID NO: 1633 - protein, 123 aa, Artificial Sequence
  Description of Artificial Sequence: Synthetic heavy chain variable region amino acid sequence
QVQLVESGPGLVKPSETLSLTCTVSGGSISRYYWSWIRQSPGKGLEWIGYIYHSVITNYNPSLKSRVTISIDMSKNQFSLKLSSVTAADTAVYYCASRPLINGYGPDNYFDYWGQGTLVTVSS

SEQ ID NO: 1634 - protein, 108 aa, Artificial Sequence
  Description of Artificial Sequence: Synthetic light chain variable region amino acid sequence
SYVLTQPPSVSVAPGQTARITCGGNNIGSKSVHWYQRKPGQAPVLVVYDDSDRPSGIPERFSGSNSGNTATLTIIRVEAGDEADYYCQVWDNSSDHPVFGGGTKLTVL

SEQ ID NO: 1635 - protein, 120 aa, Artificial Sequence
  Description of Artificial Sequence: Synthetic heavy chain variable region amino acid sequence
QVQLVQSGAEVKKPGESLKISCKGSGYSFTNYWIGWVRQMPGKGLEWMGIIFSADSDTRYSPSFQGQVTISADKSISTAYLQWSSLKASDTAMYYCARQWGITGDAFDIWGQGTMVTVSS

SEQ ID NO: 1636 - protein, 107 aa, Artificial Sequence
  Description of Artificial Sequence: Synthetic light chain variable region amino acid sequence
DIQVTQSPSFLSASVGDRVTITCRASQGISGYLAWYQQKPGKAPKLLIYAASTLQSGVPSRFSGSGSGTEFTLTISSLQPEDFATYYCQQLNSYPYTFGQGTKVEIK

SEQ ID NO: 1637 - protein, 128 aa, Artificial Sequence
  Description of Artificial Sequence: Synthetic heavy chain variable region amino acid sequence
QVQLVQSGAEVKKPGSSVKVSCKASGGSFSSNTINWVRQAPGQGLEWMGGIIPVFETPNYAQKFQGRVSFTADESTRTAYMELSSLRSEDTAVYFCARQGMSYYDTNGNYYVGWFDTWGQGTLVTVSS

SEQ ID NO: 1638 - protein, 110 aa, Artificial Sequence
  Description of Artificial Sequence: Synthetic light chain variable region amino acid sequence
EIVLTQSPGTLSLSPGERATLSCRASQSLNNNYLAWYQRKPGQAPRLLIYGAGAFSRATGIPDRFSGSGSGTDFTLTISRLEPEDFALYYCQQYGSSPLTFGQGTRLEIK

SEQ ID NO: 1639 - protein, 124 aa, Artificial Sequence
  Description of Artificial Sequence: Synthetic heavy chain variable region amino acid sequence
QVQLQQWGPGLVKPSETLSLTCTVSGASITSHYWSWLRQPAGKGLEWIGRFYPSGTTEKTPSLKSRVTLSVDTSKNHFSLKLTSVTAADTAVYYCARDSYDDIAGSYEYYFADWGQGTLVTVSS

SEQ ID NO: 1640 - protein, 107 aa, Artificial Sequence
  Description of Artificial Sequence: Synthetic light chain variable region amino acid sequence
EIVLTQSPATLSVSPGERATLSCRASQSVSSNLAWYQQKPGQAPRLLIYDISTRATGVPARFSGSGSGTEFTLTITSLQSEDFTVYYCQQYNNWPPTFGQGTKLEIK

SEQ ID NO: 1641 - protein, 129 aa, Artificial Sequence
  Description of Artificial Sequence: Synthetic heavy chain variable region amino acid sequence
EVQLLESGGGVVQPGGSLRLSCAASGFTFSGYGMHWVRQAPGKGLEWVAFIQYNGSNKYYADSVKGRFTISRDNSKNTLYVQLNSLRAEDTAVYYCATDILVVPAATPLISYYFGMDVWGQGTTVTVSS

SEQ ID NO: 1642 - protein, 110 aa, Artificial Sequence
  Description of Artificial Sequence: Synthetic light chain variable region amino acid sequence
QSALTQPASVSGSPGQSITISCTGTSSDVGGYNYVSWYQQYPGKAPKLMIYEVTNRPSGVSNRFSGSKSGNTASLTISGLQAEDEADYYCCSYTSTNTRVFGTGTKVTVL

SEQ ID NO: 1643 - protein, 123 aa, Artificial Sequence
  Description of Artificial Sequence: Synthetic heavy chain variable region amino acid sequence
QVQLVQSGAEVKMPGASVRVSCKASGYTLGSHGITWVRQAPGQGLEWMGWISANNFNTHYAQKFQGRVTMTTDTSTSTAYMELRSLRSDDTAVYYCAREVMGHMVETISFDYWGQGTLVTVSS

SEQ ID NO: 1644 - protein, 108 aa, Artificial Sequence
  Description of Artificial Sequence: Synthetic light chain variable region amino acid sequence
QPVLTQPPSVSVAPGQTARITCGGNNIGSESVHWYQQKPGQAPVLVVHDDSDRPSGIPERFSGSNSGNTATLTISRVEAGDEADYYCQVWDFTPDHPVFGGGTKVTVL

SEQ ID NO: 1645 - protein, 122 aa, Artificial Sequence
  Description of Artificial Sequence: Synthetic heavy chain variable region amino acid sequence
QVQLQESGGGVVQPGGSLRLSCAASGFTFSRHWMHWVRQVPGKGLVWVSRINSDESTIDYADSVKGRFTISRDNAKNTLYLQMNSLRAEDTAVYYCVRDMVAVPGTTGGDYWGQGTLVTVSS

SEQ ID NO: 1646 - protein, 107 aa, Artificial Sequence
  Description of Artificial Sequence: Synthetic light chain variable region amino acid sequence
SYELTQPPSVSVSPGQTADITCSGDKLGDKYACWYQQRAGQSPILVLYQDTRRPSGIPERFSGSNSGDTATLTISGTQAMDEADYYCQAWDSSTAWVFGGGTKLTVL

SEQ ID NO: 1647 - protein, 120 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVLSGYSYGYDYWGQGTLVTVSS

SEQ ID NO: 1648 - protein, 111 aa, Artificial Sequence; identical to SEQ ID NO: 740
  Description of Artificial Sequence: Synthetic light chain variable region amino acid sequence

SEQ ID NO: 1649 - protein, 127 aa, Artificial Sequence
  Description of Artificial Sequence: Synthetic heavy chain variable region amino acid sequence
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKDFTVVHPLQQLTYYYFDYWGQGTLVTVSS

SEQ ID NO: 1650 - protein, 109 aa, Artificial Sequence
  Description of Artificial Sequence: Synthetic light chain variable region amino acid sequence
DIVLTQSPATLSLSPGERATLSCRASQSVSSYLAWYQQKPGQAPRLLIYDASNRATGIPARFSGSGSGTDFTLTISSLEPEDFAVYYCQQRSNWPPGFTFGGGTKVEIK

SEQ ID NO: 1651 - protein, 127 aa, Artificial Sequence
  Description of Artificial Sequence: Synthetic heavy chain variable region amino acid sequence
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGWRGGGMTGSYYYYGMDVWGQGTTVTVSS

SEQ ID NO: 1652 - protein, 104 aa, Artificial Sequence
  Description of Artificial Sequence: Synthetic light chain variable region amino acid sequence
DIQVTQTPSTLSASVGDRVTITCRASQSISSWLAWYQQKPGKAPKLLIYKASSLESGVPSRFSGSGSGTEFTLTISSLQPDDFATYYCQQHRGTFGQGTKVDIK

SEQ ID NO: 1653 - protein, 124 aa, Artificial Sequence
  Description of Artificial Sequence: Synthetic heavy chain variable region amino acid sequence
EMQLMQSGGVVVQPGGSLRLSCAASGFTFDDYAMHWVRQAPGKGLEWVSLISWDGGSTYYADSVKGRFTISRDNSKNSLYLQMNSLRAEDTALYYCAKDFDPLVVPAAMCFDYWGQGTLVTVSS

SEQ ID NO: 1654 - protein, 111 aa, Artificial Sequence
  Description of Artificial Sequence: Synthetic light chain variable region amino acid sequence
QSVLIQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKLTVL

SEQ ID NO: 1655 - protein, 121 aa, Artificial Sequence
  Description of Artificial Sequence: Synthetic heavy chain variable region amino acid sequence
EVQLVESGGGLVQLGGPLRLSCAASGFTFSSYAMSWVRQAPGKGLEWVSAISGSGGSTYYADSVKGRFTISRDNSKNTLYLQMNSLRAEDTAVYYCAKGFERDYADAFDIWGQGTTVTVSS

SEQ ID NO: 1656 - protein, 107 aa, Artificial Sequence
  Description of Artificial Sequence: Synthetic light chain variable region amino acid sequence
DIRMTQSPSSVSASVGDRVTITCRASQGISSWLAWYQQKPGKAPKLLIYAASSLQSGVPSRFSGSGSGTDFTLTISSLQPEDFATYYCQQANSFPITFGQGTRLEIK

SEQ ID NO: 1657 - protein, 116 aa, Artificial Sequence
  Description of Artificial Sequence: Synthetic heavy chain variable region amino acid sequence
EVQLVQSGAEVKKPGASVKVSCKASGYTFTSYDINWVRQATGQGLEWMGWMNPNSGNTGYAQKFQGRVTMTRNTSISTAYMELSSLRSEDTAVYYCATRPAALDYWGQGTLVTVSS

SEQ ID NO: 1658 - protein, 106 aa, Artificial Sequence
  Description of Artificial Sequence: Synthetic light chain variable region amino acid sequence
QPVLTQPLSVSVALGQTARITCGGNNIGSKNVHWYQQKPGQAPVLIIYRDSNRPSGIPERFSGSNSGNTATLTISRAQAGDEADYYCQVWDSSTWVFGGGTKLTVL

SEQ ID NO: 1659 - protein, 120 aa, Artificial Sequence
  Description of Artificial Sequence: Synthetic heavy chain variable region amino acid sequence
QVQLVQSGGGLVKPGGSLRLSCAASGFTFRDFYMSWIRQAPGKGLEWVSNISPSSTYTNYADSVKGRFTISRDNAKNSLYLQMNSLRAEDTAVYYCVKSEGYSSGWYDYWGQGTLVTVSS

SEQ ID NO: 1660 - protein, 111 aa, Artificial Sequence
  Description of Artificial Sequence: Synthetic light chain variable region amino acid sequence
QPVLTQPPSVSGAPGQRVTISCTGSSSNIGAGYDVNWYHQLPGAAPKLLIYTNSNRPSGVPDRFSGSKSGTSASLAITGLQAEDEADYYCQSYDSSLSGYVFGTGTKLTVL

SEQ ID NO: 1661 - protein, 136 aa, Artificial Sequence
  Description of Artificial Sequence: Synthetic heavy chain variable region amino acid sequence
EVQLVESGGGLVQPGGSLRLSCAASGFTFNRFAMSWVRQAPGKGLEWVSGISGSGGSTLYADSVKGRFTISRDNSKNTLYLQINSLRVEDTAVYYCASRSSYDDVWNGYVDWDWGFDFYYYGMDVWGQGTTVTVSS

SEQ ID NO: 1662 - protein, 110 aa, Artificial Sequence
  Description of Artificial Sequence: Synthetic light chain variable region amino acid sequence
QAVVTQEPSMSAAPGQKVTISCSGGDSNIRNNYVFWYQQLPGTAPKLLIYDNTKRPSGIPGRFSGSKSGASATLDITGLQTGDEADYYCGTWDSSLSALVFGGGTQLTVL

SEQ ID NO: 1663 - protein, 123 aa, Artificial Sequence
  Description of Artificial Sequence: Synthetic heavy chain variable region amino acid sequence
EVQLLESGGGVVQPGRSLRLSCAASGFSFRNYDMHWVRQAPGKGLEWVAIISYDGSNKYADSVKGRFTISRDTSKNTLYLQMNSLRVEDTAVYYCARADSSGYYKGSEYFQHWGQGTLVTVSS

SEQ ID NO: 1664 - protein, 108 aa, Artificial Sequence
  Description of Artificial Sequence: Synthetic light chain variable region amino acid sequence
SYELTQLPSVSVAPGQTARITCGGNNIGTKSVQWYQHKPGQAPVLVVYDDSDRPSDIPERFSGSNSGNTATLTISRVEAGDEADYYCQVWDSSSDHYVFGTGTKLTVL

SEQ ID NO: 1665 - protein, 128 aa, Artificial Sequence
  Description of Artificial Sequence: Synthetic heavy chain variable region amino acid sequence
EVQLVQSGGGLVQPGGSLRVSCAASGLTVSTNYMSWVRQLPGKGLEWVSVIYSGGNTYYADSVKGRFTISRDNSKNIVYLEMNSLRIEDTAVYYCARAHLNNWFVSVTDTKDYYFDYWGQGTLVTVSS

SEQ ID NO: 1666 - protein, 106 aa, Artificial Sequence
  Description of Artificial Sequence: Synthetic light chain variable region amino acid sequence
SYELTQPPSVSVLPGQTASITCSGDKLGDKYASWYQQKPGQSPILVVFQDDKRPSGIPERFSGSNSGNTATLTISGTQATDEADYYCQACDRNTGVFGTGTKLTVL

SEQ ID NO: 1667 - protein, 122 aa, Artificial Sequence
  Description of Artificial Sequence: Synthetic heavy chain variable region amino acid sequence
EVQLLESGGGLVQPGGSLRLSCAASGFTFSPYSMNWVRQAPGKGLEWVSYISRSGSFKYYADSVKGRFTISRDDAKNSLYLHMNSLRDDDTAVYYCVSYCSSATCHQRFDYWGQGTLVTVSS

SEQ ID NO: 1668 - protein, 108 aa, Artificial Sequence
  Description of Artificial Sequence: Synthetic light chain variable region amino acid sequence
EIVLTQSPATLSLSPGERATLSCRASQSVNSYLAWYQQKPGQAPRLLIYDASNRATGIPARFSGSGSGTDFTLTISSLEPEDFAVYYCQERNSWPKLTFGGGTKVEIK

SEQ ID NO: 1669 - protein, 123 aa, Artificial Sequence
  Description of Artificial Sequence: Synthetic heavy chain variable region amino acid sequence
EVQLVESETEVKKPGASVKVSCKASGYTFTKYGISWVRQAPGQGLEWMGWISAYNGNTMYPHKLLGRVTMTTDTSTSTAYMELRSLRSDDTAVYYCARDQTYYDFWSGYYTYWGQGTLVTVSS

SEQ ID NO: 1670 - protein, 107 aa, Artificial Sequence
  Description of Artificial Sequence: Synthetic light chain variable region amino acid sequence
DIVMTQTPSTLSASVGDRVTITCRASQSISSWLAWYQQKPGKAPKLLIYKASSLESGVPSRFSGSGSGTEFTLTISSLQPDDSATYYCQQYNSYSRTFGQGTKVEIK

SEQ ID NO: 1671 - protein, 119 aa, Artificial Sequence
  Description of Artificial Sequence: Synthetic heavy chain variable region amino acid sequence
EVQLVESGGGLVQPGGSLRLSCAASGFTFSSYPMNWVRQGPGKGLEWVSSISSSGASPYYADSVKGRFTISRDNSKNTLYLQMNSLRADDTAVYYCAREDYYYYYMDVWGKGTTVTVSS

SEQ ID NO: 1672 - protein, 107 aa, Artificial Sequence
  Description of Artificial Sequence: Synthetic light chain variable region amino acid sequence
ETTLTQSPSTLSASVGDRVTITCRASESISSWLAWYQQKPGKAPKLLIFKASTVQSGVPSRFSGSGSGTEFTLTISSLQPDDFATYYCQQYNSYLLTFGGGTKVEIK

SEQ ID NO: 1673 - protein, 134 aa, Artificial Sequence
  Description of Artificial Sequence: Synthetic heavy chain variable region amino acid sequence
EVQLVESGPGLVKPSQTLSLTCSVSGGSISSGIHYWSWIRQHPGKGLEWIGYIYYSGSTYYNPSLESRITISVDTSKNQFSLKVSSVTAADTAVYYCARVNRASRMTTFGVANERSIYYFMDVWGKGTTVTVSS

SEQ ID NO: 1674 - protein, 107 aa, Artificial Sequence
  Description of Artificial Sequence: Synthetic light chain variable region amino acid sequence
ETTLTQSPATLSLSPGERATLSCRATQSVGNYLAWYQQKPGQAPRLLIHDASNRATGIPARFSGSGSGTDFTLTISSLEPEDFAVYYCQLRINWLFTFGPGTKVEIK

SEQ ID NO: 1675 - protein, 119 aa, Artificial Sequence
  Description of Artificial Sequence: Synthetic heavy chain variable region amino acid sequence
EVQLLESGGGLVKPGGSLRLSCAASGFSFSSYSMHWVRQAPGKGLEWVSSISSSSTYIYYADSVKGRFTISRDNAKTSLFLQMNSLRAEDTAVYYCARDPYSSGWYWDWGQGTTVTVSS

SEQ ID NO: 1676 - protein, 107 aa, Artificial Sequence
  Description of Artificial Sequence: Synthetic light chain variable region amino acid sequence
EIVMTQSPATLSVSPGERATLSCRASQSVSGNLAWYQQKPGQAPRLLIYGASTRATGIPARFSGSGSGTEFTLTISSLQSEDFAVYYCHQYNNRPATFGQGTKVDIK

SEQ ID NO: 1677 - protein, 121 aa, Artificial Sequence
  Description of Artificial Sequence: Synthetic heavy chain variable region amino acid sequence
EVQLLESGPGLVKPSETLSLTCNVSGGSISSYYWSWIRQSPGKGLEWIGHIYDTGYTNYNPSLKSRVTMSVDTSKNRFSLKLDSVTAADTAVYYCARGRGWRNLYNWFDPWGQGTLVTVSS

SEQ ID NO: 1678 - protein, 107 aa, Artificial Sequence
  Description of Artificial Sequence: Synthetic light chain variable region amino acid sequence
DIVMTQSPATLSVSPGERATLSCRTSQSFSSMLAWYQQKPGQAPRLLIYGASTRATGIPARFSGSGSATEFTLTISNLQSEDVAVYYCQQYNSWPLTFGGGTKVEIK

SEQ ID NO: 1679 - protein, 123 aa, Artificial Sequence
  Description of Artificial Sequence: Synthetic heavy chain variable region amino acid sequence
EVQLLESGGGLVKPGGSLRLSCEVSGFPFSDYYVSWIRQAPGKGLEWLSYSSRGGIYTNYADSVKGRFTISRDNDKNSLFLQMNSLRAEDTAVYYCARDRSDIWSGRVGFDYWGQGTLVTVSS

SEQ ID NO: 1680 - protein, 110 aa, Artificial Sequence
  Description of Artificial Sequence: Synthetic light chain variable region amino acid sequence
DIVMTQSPATLSLSPGERATLSCRASQSVSSSYLAWYQQKPGQAPRLLIYGASSRATGIPDRFSGSGSGTDFTLTISRLEPEDFAVYYCQQYNKSPPGYIFGPGTKVDIK

SEQ ID NO: 1681 - protein, 122 aa, Artificial Sequence
  Description of Artificial Sequence: Synthetic heavy chain variable region amino acid sequence
QVQLVQSGPTLVKPTQTLTLTCSFSGFSLTNTGVGVGWIRQPPGKALEWLALIYWDDDKRYRPSLKSRLTITKDTSKSQVVLTMTNMDPLDTATYYCAHRRSAYDPIYFDYWGQGALVTVSS

SEQ ID NO: 1682 - protein, 108 aa, Artificial Sequence
  Description of Artificial Sequence: Synthetic light chain variable region amino acid sequence
DIRVTQSPSSVSASVGDRVTITCRASRSINNWLAWYQQKPGKAPKLLIYAASSLQSGVPSRFSGSGYGTDFTLTISSLQPEDFATYYCQQAHSFPSITFGQGTRLEIK

SEQ ID NO: 1683 - protein, 126 aa, Artificial Sequence
  Description of Artificial Sequence: Synthetic heavy chain variable region amino acid sequence
QVQLVQSGAEVKKPGASVRVSCKTSGYAFSKYGISWVRQAPGQGLEWIGWISAYNENTHFSHKFLGRVTMTTDTSTGIAYMDLRSLKSDDTAVYYCARDWYSLGSDWYFGPMFDYWGQGTLVTVSS

SEQ ID NO: 1684 - protein, 107 aa, Artificial Sequence
  Description of Artificial Sequence: Synthetic light chain variable region amino acid sequence
EIVLTQSPDTLSVSPGERATLSCRASQSVTTNLAWYQQKPGHAPRLLIYGASTRATGIPARFSGSGSGTEFTLTISSLQSEDFAIYYCQQYTNWPRTFGQGTKVEIK

SEQ ID NO: 1685 - protein, 116 aa, Artificial Sequence
  Description of Artificial Sequence: Synthetic heavy chain variable region amino acid sequence
QVQLVESGPGLVKPSETLSLTCTVSDDSITNNFWTWIRQPPGKGLEWIGYIYYSGSTNYNPSLKSRITMSVDLSKNQFSLKLSSVTAADTAVYYCARLTSGGVDYWGQGTLVTVSS

SEQ ID NO: 1686 - protein, 111 aa, Artificial Sequence
  Description of Artificial Sequence: Synthetic light chain variable region amino acid sequence
QSVLTQPPSLSGAPGQRVTISCTGSSSNIGADYHVHWYQQLPGTAPKLLIYQNTNRPSGVPDRFSASKSGTSVSLAITGLQAEDEADYYCQSYDSSLSAWVFGGGTKLTVL

SEQ ID NO: 1687 - protein, 129 aa, Artificial Sequence
  Description of Artificial Sequence: Synthetic heavy chain variable region amino acid sequence
QVQLVQSGAEVKKPGSSVKVSCKAFGGTLRRYALSWVRQAPGQGLEWMGGIIPVFGTRRYAQKFQGRITITADGSTSTASMEVSSLRFEDTAIYYCATVYFDFVSGPPPTYYYYYMDVWGKGTTVTVSS

SEQ ID NO: 1688 - protein, 110 aa, Artificial Sequence
  Description of Artificial Sequence: Synthetic light chain variable region amino acid sequence
DIVMTQSPGTLSLSPGERATLSCRASQSVSSSYLAWYQQKPGQAPRLLIYGASSRATGIPDRFSGSGSGTDFTLTISRLEPEDFAVYYCQQYDSSLRVLTFGGGTKVDIK

SEQ ID NO: 1689 - protein, 123 aa, Artificial Sequence
  Description of Artificial Sequence: Synthetic heavy chain variable region amino acid sequence
QVQLQQWGAGLLKPSETLSLTCEVYGGSFSGYYWTWFRQPPGEGLEWIGEINHSGGTNYNPSLKSRVTMSVDASINQFSLQLSSVTAADTSVYYCARGHYYNTNDFYGLFDYWGQGTLVTVSS

SEQ ID NO: 1690 - protein, 108 aa, Artificial Sequence
  Description of Artificial Sequence: Synthetic light chain variable region amino acid sequence
DIRLTQSPSFLSASVGDRVTITCRASQGISTYLAWYQQKPGKAPKLLLYAASTLHSGVPSRFSGSGSGTEFTLTISSLQPEDFATYYCQQLNRYPPSTFGPGTKLEIK

SEQ ID NO: 1691 - protein, 130 aa, Artificial Sequence
  Description of Artificial Sequence: Synthetic heavy chain variable region amino acid sequence
QVQLQQWGARLLKPSETLSLTCAVYGGSFSGYYWSWIRQSPGKGLEWIGEINHSGSTNYNPSLKSRVTISRDTSKKQFSLKVSSVTAADTAVYYCARDPPIRCNGDSCKSDQYRYGMDVWGQGTTVTVSS

SEQ ID NO: 1692 - protein, 108 aa, Artificial Sequence
  Description of Artificial Sequence: Synthetic light chain variable region amino acid sequence
QPGLTQPPSVSVSPGQTARITCSGDALPKQYAYWYQQKPGQAPVLVIHKDNERPSGIPERFSGSSSGTTVTLTISGVQAEDEADYYCQSADTSGSYRLFGGGTKLTVL

SEQ ID NO: 1693 - protein, 128 aa, Artificial Sequence
  Description of Artificial Sequence: Synthetic heavy chain variable region amino acid sequence
EVQLLESGAEVKKPGSSVKVSCKASGGTFSTYAISWVRQAPGQGLEWMGGIIPVLGTTKYAQKFQDRVTITADESTSTAYMDLSGLRSDDTAVYYCARGVWGDCGRASCLFDWYFDLWGRGTLVTVSS

SEQ ID NO: 1694 - protein, 108 aa, Artificial Sequence
  Description of Artificial Sequence: Synthetic light chain variable region amino acid sequence
EIVMTQSPATLSVSPGERVTLSCSASQTVSSNLAWYQQKPGQAPRLLIYGASIRATDIPARFSGSGSRTEFTLTISSLQSEDFAVYYCQQYNNRPPLTFGGGTKVEIK

SEQ ID NO: 1695 - protein, 127 aa, Artificial Sequence
  Description of Artificial Sequence: Synthetic heavy chain variable region amino acid sequence
QVQLVQSGAEVKKPGSSVKVSCMASGGTFSNSAINWVRQAPGQGLEWMGGTIPIFGAANYAQRFQARVTITADKSTSTAYMELTSLRSDDTAVYYCVRTPHRSSDHIWGSYRYFDSWGQGTLVTVSS

SEQ ID NO: 1696 - protein, 111 aa, Artificial Sequence
  Description of Artificial Sequence: Synthetic light chain variable region amino acid sequence
QSVVTQEPSVSAAPGQKITISCSGSTSNIGINYVSWYQQFPGTAPKLLIYDNDKRPSGIPDRFSGSKSGTSATLGITGLQAGDEADYYCGTWDSSLSAGHIFGGGTKVTVL

SEQ ID NO: 1697 - protein, 125 aa, Artificial Sequence
  Description of Artificial Sequence: Synthetic heavy chain variable region amino acid sequence
EVQLLESGGGLVKPGGSLRLSCEASGFPFNSYHMNWIRQSPGKGLEWVSYITGGSSFSNYADSVKGRFTISRDNAKNSLYLQMNSLRAEDTAVYYCARTTLDCTSTSCHYRFDYWGQGTLVTVSS

SEQ ID NO: 1698 - protein, 112 aa, Artificial Sequence
  Description of Artificial Sequence: Synthetic light chain variable region amino acid sequence
QSVLTQPPSVSGAPGQRITISCNGSNSNIGAGYDVHWYQQLPGKAPKLLIYSNNNRPSGVPDRFSGSKSGTSASLAITGLQGEDEADYYCQSHDTRLSGNVVFGGGTKLTVL

SEQ ID NO: 1699 - protein, 120 aa, Artificial Sequence
  Description of Artificial Sequence: Synthetic heavy chain variable region amino acid sequence
QITLKESGPTLVKPTQTLTLTCTFSGFSLSTSGVGVAWIRQPPGKALEWLALIYWDDDKRYSPSLKSRLTITKDTSKNQVVLTMTNMDPVDTATYYCAHSSVYTTPFDYWGQGSLVTVSS

SEQ ID NO: 1700 - protein, 106 aa, Artificial Sequence
  Description of Artificial Sequence: Synthetic light chain variable region amino acid sequence
DIQLTQSPSTLSASVGDRVTITCRASQSISDWLAWYQQKPGKAPKLLIYKAFTLESGVPSRFSGSGSGTEFTLTISSLQPDDFATYYCQQYTSYWTFGQGTKVEIK

SEQ ID NO: 1701 - protein, 121 aa, Artificial Sequence
  Description of Artificial Sequence: Synthetic heavy chain variable region amino acid sequence
QVTLKESGPTLVKPTQTLTLSCSFSGFSLSAYAVGVGWIRQPPGKALEWLALIYWDDDKRYSPSLETRLTITKDTSKNQVVLTMTKMDPVDTATYYCVYSYNGYYEYMDVWGNGTTVTVSS

SEQ ID NO: 1702 - protein, 107 aa, Artificial Sequence
  Description of Artificial Sequence: Synthetic light chain variable region amino acid sequence
DIVMTQSPATLSLSPGERATLSCRASQSVSNYLAWYQQKPGQAPRLLISGASNRATGIPDRFSGSGSGTDFTLTITTPEPEDFAVYYCQQRNAWPRTFGQGTKVEIK

SEQ ID NO: 1703 - protein, 124 aa, Artificial Sequence
  Description of Artificial Sequence: Synthetic heavy chain variable region amino acid sequence
EVQLVESGGGVVQPGRSLRLSCAASGFTLSSYVMDWVRQAPGKGLEWVAVISYDGSSKYYADSVKGRFTVSRDNSNNAMYLQMNSLRAEDTAVYYCARDPYYDILTGYSYFDYWGHGTTVTVSS

SEQ ID NO: 1704 - protein, 110 aa, Artificial Sequence
  Description of Artificial Sequence: Synthetic light chain variable region amino acid sequence
SYVLTQPPSVSGAPRQTATITCGGNNIGSKSVNWYQQKPGQAPVLVVYDDSARPSGIPERFSGSNSGNTATLTVSSVEAGDEADYFCQVWDTSSAPYPWVFGGGTKLTVL

SEQ ID NO: 1705 - protein, 119 aa, Artificial Sequence
  Description of Artificial Sequence: Synthetic heavy chain variable region amino acid sequence
QVQLVESGAEARKPGSSVKVSCKLSGGTFSTDPISWVRQAPGQGLEWMGRIIPLLGIANYAQKFQGRVTIIADKSTSTVYMELRNLRFEDTAVYFCARRGDGYYGMDVWGQGTTVTVSS

SEQ ID NO: 1706 - protein, 111 aa, Artificial Sequence
  Description of Artificial Sequence: Synthetic light chain variable region amino acid sequence
QSVLTQPASVSGSPGQSITISCTGTSNDIGGYDYVSWYQQHPGKAPKLMIYDVHNRPSGVSNRFSGSKSGNTASLTISGLQAEDEADYYCSSFSDSGNLYVFGTGTKLTVL

SEQ ID NO: 1707 - protein, 127 aa, Artificial Sequence
  Description of Artificial Sequence: Synthetic heavy chain variable region amino acid sequence
QVQLQQWGAGLLKPSETLSLTCAVYGGSFSGYYWSWIRQPPGKGLEWIGEMNHSGGSNYNPSFKSRVTISVDTSKKYFSLNLSSVTAADTAIYYCARTPFYYESTGYYYYYYGMDVWGQGTTVTVSS

SEQ ID NO: 1708 - protein, 113 aa, Artificial Sequence
  Description of Artificial Sequence: Synthetic light chain variable region amino acid sequence
DIVMTQTPDSLAVSLGERATINCKSSQSVSHSSNNKNYLSWYQQKPGQPPKLLIYWASIRESEAPDRFTGSGSGTDFTLTISSLQAEDVAVYYCQQYYTAPITFGQGTRLEIK

SEQ ID NO: 1709 - protein, 123 aa, Artificial Sequence
  Description of Artificial Sequence: Synthetic heavy chain variable region amino acid sequence
EVQLLESGSELKKPGASVKISCKTSGYTFTNYLMNWVRQAPGQGLEWMGWINTHTGNPTYAQDFTGRFVFSLDTSVNTAYLQISSLKAEDTAIYYCARDGLEAFSGYNGVDYWGQGTLVTVSS

SEQ ID NO: 1710 - protein, 112 aa, Artificial Sequence
  Description of Artificial Sequence: Synthetic light chain variable region amino acid sequence
DIVMTQTPLSLPVTPGEPASISCRSSPSLLHSNGYNYLDWYLQKPGQSPQLLIYLGSTRASGVPDRFSGSGSGTDFTLRISRVEAEDVGVYYCMQALQIPLTFGQGTKLEIK

SEQ ID NO: 1711 - protein, 124 aa, Artificial Sequence
  Description of Artificial Sequence: Synthetic heavy chain variable region amino acid sequence
EVQLVESGPGLVKPSQTLSLTCTVSGGPISSGVYYWSWIRQHPGKGLESIGYIYYSGSTHYNPSLKTRVTISLDTSKNQFSLKLSSVTAADTAVYYCARGCSGGSCYLYAFDIWGQGTTVTVSS

SEQ ID NO: 1712 - protein, 108 aa, Artificial Sequence
  Description of Artificial Sequence: Synthetic light chain variable region amino acid sequence
QPVLTQPPSVSVAPGQTARITCGGNNIGTKSVHWYQQKPGQAPLLVVYDDSDRPSGIPERFSGSNSGNTATLTISRVEAGDEADFYCQVWDYATDHVVFGGGTKLTVL

SEQ ID NO: 1713 - protein, 119 aa, Artificial Sequence
  Description of Artificial Sequence: Synthetic heavy chain variable region amino acid sequence
QVQLVQSGAEVKKPGSSVKVSCKASGGTFSRHTITWVRQAPGQGLEWMGRIAPIVGFANYAQKFQGRVTITADKSTSTAYMELRSLRSEDTAVYYCARRSEDYYGLDVWGQGTTVTVSS

SEQ ID NO: 1714 - protein, 104 aa, Artificial Sequence
  Description of Artificial Sequence: Synthetic light chain variable region amino acid sequence
DIVMTQSPSSLSASVGDRVTITCQASQDISNYLNWYQQKPGKAPKLLIYEASNLETGVPSRFSGSGSGTDFTFTISSLQPEDIATYYCQQYDNLFGGGTKLEIK

SEQ ID NO: 1715 - protein, 121 aa, Artificial Sequence
  Description of Artificial Sequence: Synthetic heavy chain variable region amino acid sequence
QVQLVESGAEVKKPGASVKVSCKASGYTFTDYYIHWVRQAPGQGLEWVGRINPNSGYINYAQKFQGRLTMTRDTSISTAYLELSSLRSDDTAVYYCTRLPLLEPLNFFDYWGQGTLVTVSS

SEQ ID NO: 1716 - protein, 112 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKVLIYGNNNRPSGVPDRFSGSKSGTSASLAITGLQAEDEADYYCQSFDSSLSSSYVFGTGTKLTVL

SEQ ID NO: 1717 - protein, 123 aa, Artificial Sequence
  Description of Artificial Sequence: Synthetic heavy chain variable region amino acid sequence
EVQLLESGGGLVKPGGSLRLSCAASGFTFADYYMSWIRQAPGKGLEWVSYISGGSSFTNYADSVKGRFTISRDNAKNSLYLQMNSLRADDTAVYYCARGISPALGGGEYFQDWGQGTLVTVSS

SEQ ID NO: 1718 - protein, 111 aa, Artificial Sequence
  Description of Artificial Sequence: Synthetic light chain variable region amino acid sequence
QPVLTQPPSVSGAPGQRVTISCTGSSSNIGAGYDVHWYQHLPGTAPKLLIYGNSNRPSGVPDRFSGSKSSTSASLAITGLQAEDEADYYCQSYDSSLGGYVFGTGTKVTVL

SEQ ID NO: 1719 - protein, 115 aa, Artificial Sequence
  Description of Artificial Sequence: Synthetic heavy chain variable region amino acid sequence
QVQLQQWGAGLLKPSETLSLTCAVYGGSFSGYSWSWIRQPPGKGLEWIGDIDHDGSTYYNSSLKSRVTMSIDTSKNQFSLKLSSVTAADTAVYYCARVGGNSGYWGQGTLVTVSS

SEQ ID NO: 1720 - protein, 111 aa, Artificial Sequence
  Description of Artificial Sequence: Synthetic light chain variable region amino acid sequence
DIVMTQTPLSLPVTPGEPASISCRSSQSLLHSNGFNYLDWYLQKPGQSPQLLIYLGSNRASGVPDRFSGSGSGTDFTLKISRVEAEDVGVYYCMQALQTLTFGPGTKVEIK

SEQ ID NO: 1721 - protein, 115 aa, Artificial Sequence
  Description of Artificial Sequence: Synthetic heavy chain variable region amino acid sequence
QVQLVQSGAGLLKPSETLSLTCAVYGGSFSGYSWSWIRQPPGKGLEWIGEINYSVSTSYNSSLKSRVSISVDTSKNQFSLKLTSVTAADTAVYYCARVGGAVADWGQGTLVTVSS

SEQ ID NO: 1722 - protein, 111 aa, Artificial Sequence
  Description of Artificial Sequence: Synthetic light chain variable region amino acid sequence
EIVLTQSPLSLPVTPGEPASISCRSSQRLLHSNGYNYLDWYLQKPGQSPQLLIYLGSNRASGVPDRFSGSGSGTDFTLKISRVEAEDVGVYYCMQNLQTLTFGGGTKVDIK

SEQ ID NO: 1723 - protein, 122 aa, Artificial Sequence
  Description of Artificial Sequence: Synthetic heavy chain variable region amino acid sequence
QVQLVESGPTLVKPTQTLTLTCTFSGFSLSTNGVGVAWIRQPPGKALEWLAIIYWDDDKRYSPSLKSRLTITKDTSKNQVVLTVTDMDPVDTATYYCAHTIGVPAATRFDYWGQGTLVTVSS

SEQ ID NO: 1724 - protein, 108 aa, Artificial Sequence
  Description of Artificial Sequence: Synthetic light chain variable region amino acid sequence
SYELTQPPSVSVSPGQTASITCSGDKLGDKFACWYQQKPGQSPVLVIYQDNKRPSGIPERFSGSNSGNTATLTISGTQAMDEADYYCQAWDSSTASYVFGTGTKLTVL

SEQ ID NO: 1725 - protein, 122 aa, Artificial Sequence
  Description of Artificial Sequence: Synthetic heavy chain variable region amino acid sequence
EVQLLESGGGLVQPGGSLRLSCAASGFTFNFFALTWVRQAPGKGLEWVSAISGSGESTYYADSVKGRFTISRDNSKNTLYLQMNSLRAEDTAVYYCAKFARSGDYASFFDYWGQGTLVTVSS

SEQ ID NO: 1726 - protein, 113 aa, Artificial Sequence
  Description of Artificial Sequence: Synthetic light chain variable region amino acid sequence
DIRVTQSPDSLAVSLGERATINCKSSQNVFYSSNNKNFLAWYQQKPGQPPKLLIYWASTRESGIPDRFSGSGSGTDFTLTISSLQAEDVAVYYCQQYYSTKFTFGPGTKVEIK

SEQ ID NO: 1727 - protein, 122 aa, Artificial Sequence
  Description of Artificial Sequence: Synthetic heavy chain variable region amino acid sequence
EVQLVQSGGGLVKPGGSLRLSCTASGFTFSDHYMSWIRQAPGKGLEWISYISSTSSFTNYANSVKGRFTISRDNAKNSLYLQMNSLRAEDTAVYYCARDRSILYSGYSLDYWGQGTLVTVSS

SEQ ID NO: 1728 - protein, 106 aa, Artificial Sequence
  Description of Artificial Sequence: Synthetic light chain variable region amino acid sequence
DIQMTQSPSSLSASVGDRVTISCRASQSILNYLNWYQHKPGKAPKLLIYAASSLQSGVPSRFSGSGSGTDFTLTISGLQPEDFATYYCQQSDSTRTFGQGTKVEIK

SEQ ID NO: 1729 - protein, 122 aa, Artificial Sequence
  Description of Artificial Sequence: Synthetic heavy chain variable region amino acid sequence
QVTLKESGGGLVKPGGSLRLSCAASGFTFSDYYMSWIRQAPGKGLEWVSYISSSSSYTNYADSVKGRFTISRDNAKNSLYLQMNSLRAEDTAVYYCAREAVAAAGTDYFDYWGQGTLVTVSS

SEQ ID NO: 1730 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQPPRTAPKLLIYGNSNRPSGVPDRFSGSKSGTSASLAITGLQAEDEADYYCQSYDSSLSGYVFGTGTKLTVL

SEQ ID NO: 1731 - protein, 126 aa, Artificial Sequence
  Description of Artificial Sequence: Synthetic heavy chain variable region amino acid sequence
EVQLVESGSELKKPGASVKVSCKASGYTFRTYVMNWVRQAPGQGLEWMGWINTNTGNPTYAQGFTGRFVFSLDTSVSTAYLQISSLKAEDTAVYYCARESIDDYDSSGYGRTFDYWGQGTLVTVSS

SEQ ID NO: 1732 - protein, 108 aa, Artificial Sequence
  Description of Artificial Sequence: Synthetic light chain variable region amino acid sequence
SYELTQPPSVSVSPGQTASIPCSGDKVGKTYVYWYQQTPGQSPGLVIYQDTKRPSGIPERFSGSSSGNTATLTISGTQTMDEADYYCQAWDTSTASYVFGTGTKLTVL

SEQ ID NO: 1733 - protein, 123 aa, Artificial Sequence
  Description of Artificial Sequence: Synthetic heavy chain variable region amino acid sequence
QVQLVQSGVEVKKPGESLKISCKGSGYSFTNYWIAWVRQMPGKGLEWMGIIYPGDSDTRYSPSFQGQVTISADKSISTAYVQWSSLKASDTAIYYCARGDILTNSGPDAFDIWGQGTMVTVSS

SEQ ID NO: 1734 - protein, 107 aa, Artificial Sequence
  Description of Artificial Sequence: Synthetic light chain variable region amino acid sequence
DIQMTQSPSSFSASTGDRVTITCRASQAISSYLAWFQQKPGKAPKLLIYAASTLQSGVPSRFSGSGSGTDFTLTISCLQSEDFATYYCQQYYSYPLTFGGGTKVEIK

SEQ ID NO: 1735 - protein, 124 aa, Artificial Sequence
  Description of Artificial Sequence: Synthetic heavy chain variable region amino acid sequence
EVQLVESGGGLVKPGGSLRLSCAASGFSFSSYYMNWVRQAPGKGLEWVSSISPSSSYTNYADSVKGRFTISRDNAKDSLYLQMNSLRAEDTAVYYCARDGLLGITIFGVVQDYWGQGTLVTVSS

SEQ ID NO: 1736 - protein, 110 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNTNRPSGVPDRFSASKSGTSASLAITGLQAEDEADYYCQSYDSSLSVVFGGGTKLTVL

SEQ ID NO: 1737 - protein, 120 aa, Artificial Sequence
  Description of Artificial Sequence: Synthetic heavy chain variable region amino acid sequence
QVQLVQSGGGVVQPGGSLRLSCAASGFTFSDYGMHWVRQAPGKGLEWVAVISDGGSNQYSADSVRGRFTISRDNSKNTLYLQMNSLRPEDTAVYYCAKARIAARAIFDYWGQGTLVTVSS

SEQ ID NO: 1738 - protein, 107 aa, Artificial Sequence
  Description of Artificial Sequence: Synthetic light chain variable region amino acid sequence
DIQLTQSPSSLSASVGERITITCQASRDVRIYLNWYQHKPGKAPKLLIYDASNLETGVPSRYSGSGSGTDFTFTISSLQPEDIATYFCQQYDLLPPTFGVGTKVEIK

SEQ ID NO: 1739 - protein, 130 aa, Artificial Sequence
  Description of Artificial Sequence: Synthetic heavy chain variable region amino acid sequence
QVQLQQWGAGLLKPSETLSLTCAVYGDSFSGYFWTWIRQPPGKGLEWIGEINLSGSTNYNPSLKSRVTILVDTSKNQFSLKLSSVTAADTAVYYCARGLHVSDDQDSSGYYFHPGSFDYWGQGTLVTVSS

SEQ ID NO: 1740 - protein, 113 aa, Artificial Sequence
  Description of Artificial Sequence: Synthetic light chain variable region amino acid sequence
DIRMTQSPDSLAVSLGERATINCKSSQSVLYSSNNKNYLAWYQQKPGQPPKLLINWASTRESGVPDRFSGSGSGTDFTLAISSLQAEDVAVYYCQQYYSTPLTFGGGTKVEIK

SEQ ID NO: 1741 - protein, 126 aa, Artificial Sequence
  Description of Artificial Sequence: Synthetic heavy chain variable region amino acid sequence
QVQLQESGPGLVKPSETLSLTCTVSGASVSSNNYYWSWIRQPPGKGLEWIGYIYYSGSTNYNASLKSRVTISVDTSKNQFSLKLSSVTAADTALYYCAGEHIFGVASPFEAPFDYWGQGTMVTVSS

SEQ ID NO: 1742 - protein, 108 aa, Artificial Sequence
  Description of Artificial Sequence: Synthetic light chain variable region amino acid sequence
SSELSQPPSVSVAPGKTARITCGGNNIGIKSVHWYQQKPGQAPVLVIYSDSDRPSGIPERFSGSNSGNTATLTITRVEAGDEADYYCQVWDSSSDHFVFGIGTKVTVL

SEQ ID NO: 1743 - protein, 124 aa, Artificial Sequence
  Description of Artificial Sequence: Synthetic heavy chain variable region amino acid sequence
EVQLVESGPGLVKPSETLSLTCTVSGGSITPYYWSWIRQPPGKGLEWIGNISYSGSTTYNPSLKSRVTISVDRSKDQFSLRLRSVTAADTAVYYCARVVTLVLGVSLNDAFDIWGQGTMVTVSS

SEQ ID NO: 1744 - protein, 107 aa, Artificial Sequence
  Description of Artificial Sequence: Synthetic light chain variable region amino acid sequence
DIQMTQSPSSLSASVGDRVTITCRASQSISRYLNWYQHKPGKAPILLIYAATTLESGVPPRFSGSGSGTDFSLTISSLQPEDFATYYCQQSYSVPLTFGGGTKLEIK

SEQ ID NO: 1745 - protein, 122 aa, Artificial Sequence
  Description of Artificial Sequence: Synthetic heavy chain variable region amino acid sequence
EVQLLESGGGLVQPGGSLRLSCAASGFIFSNYEMNWVRQAPGKGLEWISHITPTGNSIYYADSVKGRFTISRDNAKNAQYLQMHSLRPDDTAIYYCARGEDPIAATGGFDSWGQGTLVTVSS

SEQ ID NO: 1746 - protein, 107 aa, Artificial Sequence
  Description of Artificial Sequence: Synthetic light chain variable region amino acid sequence
EIVLTQSPSSLSASVGDRVTIPRRSSQNVDKFLHWYQQRPGKAPKLLIYAAFSLQSGVPSRFSGSGSGTDFTLTISSLQPEDFATYYCQQSYSTPFTFGQGTKVEIK

SEQ ID NO: 1747 - protein, 123 aa, Artificial Sequence
  Description of Artificial Sequence: Synthetic heavy chain variable region amino acid sequence
EVQLLESGGNMVQPGKSLRLSCAASGFTFSNYGMHWVRQAPGKGLEWVAVISKDGNNEHYADSVRARFTVSRDNSKNTLFLQMNSLRPEDTAVYYCAIGGLSGSYFGEYFQHWGRGTLVTVSS

SEQ ID NO: 1748 - protein, 107 aa, Artificial Sequence
  Description of Artificial Sequence: Synthetic light chain variable region amino acid sequence
DIQMTQSPSSMSASLGDRVTITCRASQGISTWLAWYQQKPGEAPKLLIYAAFGLQSGVPSRFSGSGSGTDFTLTINNLQPEDFATYYCQQAISFPFTFGGGTKVEIK

SEQ ID NO: 1749 - protein, 122 aa, Artificial Sequence
  Description of Artificial Sequence: Synthetic heavy chain variable region amino acid sequence
EVQLLESGGGLVKPGGSLRLSCAGSGFRFSDYYMTWIRQAPGKGLEWVSYISSSSTYTYYTDSVKGRFTVSRDNAKNSLYLQMNTLRAEDTAIYYCAISNRYDSRTFYYDYWGQGTLVTVSS

SEQ ID NO: 1750 - protein, 110 aa, Artificial Sequence
  Description of Artificial Sequence: Synthetic light chain variable region amino acid sequence
QSVLTQPPSVSGAPGQRVIISCTGSSSNIGAGYDVHWYQQFPGTAPKLLIYGNNNRPSGVPERFSGSKSGTSASLAITGLQADDEADYYCQSYDSLSEVVFGGGTKVTVL

SEQ ID NO: 1751 - protein, 117 aa, Artificial Sequence
  Description of Artificial Sequence: Synthetic heavy chain variable region amino acid sequence
EVQLQESGPGLVKPSETLSLTCTVSGGSLSGYYWSWIRQPPGKGLEWIGYIYHSGSTNYNPSLESRVTISVDTSKNQFSLKVNAVTAADTAVYYCAKVERLLRFDPWGQGTLVTVSS

SEQ ID NO: 1752 - protein, 110 aa, Artificial Sequence
  Description of Artificial Sequence: Synthetic light chain variable region amino acid sequence
QSVLIQPASVSGSPGQSITISCIGSSSDVGGYNYVSWYQHYPGKAPKLMIYDVSNRPSGVSNRFSGSKSGNTASLTISGLQAEDEADYYCSSYTSSTSYVFGTGTKVTVL

SEQ ID NO: 1753 - protein, 121 aa, Artificial Sequence
  Description of Artificial Sequence: Synthetic heavy chain variable region amino acid sequence
EVQLVESGGGLVKPGRSLRLSCTTSGFTFGDYAMSWFRQAPGKGLEWVGFIRSKPYGGATAYAASVRGRFTISNDDSKSIAYLQMESLKIEDTAVYYCARDYDDFFFYDYWGQGTLVTVSS

SEQ ID NO: 1754 - protein, 106 aa, Artificial Sequence
  Description of Artificial Sequence: Synthetic light chain variable region amino acid sequence
DIRMTQSPATLSVSPGERATLSCRASENIYSNLAWYQQKPGQAPRLLIYGASTRATGLPARFSGSGSGTEFTLTISSLQSEDFAVYYCQQYNNWPAFGGGTKVEIK

SEQ ID NO: 1755 - protein, 119 aa, Artificial Sequence
  Description of Artificial Sequence: Synthetic heavy chain variable region amino acid sequence
QVTLKESGAEVKKPGASVKVSCKASGYTFTGYYMHWVRQAPGQGLEWMGRINPNSGGTNYAQKFQGRVTMTRDTSISTAYMELSRLRSDDTAVYYCAREASRFGGFDYWGQGTLVTVSS

SEQ ID NO: 1756 - protein, 108 aa, Artificial Sequence
  Description of Artificial Sequence: Synthetic light chain variable region amino acid sequence
DIVLTQSPSSLSASVGDRVTITCQASQDISNYLNWYQQKPGKAPKLLIYDASNLETGVPSRFSGSGSGTDFTFTISSLQPEDIATYYCQQYDNLLGYTFGQGTKVEIK

SEQ ID NO: 1757 - protein, 127 aa, Artificial Sequence
  Description of Artificial Sequence: Synthetic heavy chain variable region amino acid sequence
QVQLVESGPGLVKPSQTLSLTCSVSGGSISSDDHYWSWIRQHPGKGLEWIGYIYYSGYTNYNPSLKSRVTISVDTSKNQFSLRLSSVTAADTAVYYCARETDITIFGVVPVGYFDYWGQGTLVTVSS

SEQ ID NO: 1758 - protein, 113 aa, Artificial Sequence
  Description of Artificial Sequence: Synthetic light chain variable region amino acid sequence
DIQVTQSPDSLAVSLGERATINCKSSQSILSSTNNKNFLAWYQQKPGQPPKLLLHWASTREFGVPDRFSGSGSGTEFTLTISSLQAEDVAVYYCQQYYTTPYTFGQGTKVEIK

SEQ ID NO: 1759 - protein, 121 aa, Artificial Sequence
  Description of Artificial Sequence: Synthetic heavy chain variable region amino acid sequence
EVQLLESGPGLVKPSETLSLTCTVSGGSVSSGGYYYTWIRQPPGKGLEWIGYAFYSGDTNYNPSLKSRVTISVDTSKNQFSLKLTSVTAADTAVYYCASTYTFGASGFDFWGQGTLVTVSS

SEQ ID NO: 1760 - protein, 107 aa, Artificial Sequence
  Description of Artificial Sequence: Synthetic light chain variable region amino acid sequence
DIVMTQSPSFMSASVGDRVTITCRASQGISNWLLWYQQKPGKAPKLLIYAASSLQSGVPSRFSGSRSGTDFTLTISSLQPEDFAIYYCQQANSFPLTFGQGTRLEIK

SEQ ID NO: 1761 - protein, 121 aa, Artificial Sequence
  Description of Artificial Sequence: Synthetic heavy chain variable region amino acid sequence
EVQLVESGPGLVKPSQTLSLTCTVSGGSINIGGYYWSWIRQHPEKGLEWIGYIYYSGTTYYNPSLESRVTISIDTSKNQFSLNLSSVTAADTAVYYCASVDQIGATRFDYWGQGTLVTVSS

SEQ ID NO: 1762 - protein, 112 aa, Artificial Sequence
  Description of Artificial Sequence: Synthetic light chain variable region amino acid sequence
QPVLTQPRSVSGSPGQSVTLSCTGTSSDVGTYNYVSWYQHHPGKAPKLIIYDVNKRPSGVPDRFSGSKSGNTASLTISGLQAEDEADYYCCSYAGSYTLNYVFGTGTKLTVL

SEQ ID NO: 1763 - protein, 118 aa, Artificial Sequence
  Description of Artificial Sequence: Synthetic heavy chain variable region amino acid sequence
QVQLVQSGDEVKKPGESLKISCKGSEHTFTNYWIAWVRQMPGKGLECMGVIWPDDSDTKYSPSFQGQVTISADKSINTAYLHLSSLRASDTAMYYCATSKFRTGFDFWGQGTLVTVSS

SEQ ID NO: 1764 - protein, 111 aa, Artificial Sequence
  Description of Artificial Sequence: Synthetic light chain variable region amino acid sequence
NFMLTQPHSVSESPGKTVIISCTRSSGNIASNYVQWYQQRPGSSPTTVVYEDNQRPSGVPDRFSGSIDSSSNSASLTISGLKTEDEADYYCQSYDSSNPWVFGGGTKLTVL

SEQ ID NO: 1765 - protein, 123 aa, Artificial Sequence
  Description of Artificial Sequence: Synthetic heavy chain variable region amino acid sequence
QVQLVESGAEVKKPGASVKVSCKASGYSFTSYYMHWVRQAPGQGLEWMGVISTNGGTASYSQNFRGRVTLTRDTSTSTAYMELSSLTSEDTAVYYCVREGYCNGGSCSYFDSWGQGTLVTVSS

SEQ ID NO: 1766 - protein, 110 aa, Artificial Sequence
  Description of Artificial Sequence: Synthetic light chain variable region amino acid sequence
QSVLTQPPSVSGAPGQRVSISCTGSSSNIGAGYDVHWYQQLPGTAPKVLIYGNNYRPSGVPDRFSGSKSGTSASLAITGLQTEDEADYYCQSYDSRLSVVFGGGTKLTVL

SEQ ID NO: 1767 - protein, 121 aa, Artificial Sequence
  Description of Artificial Sequence: Synthetic heavy chain variable region amino acid sequence
EVQLLESGGGVVQPGRSLRLSCAASELSFRNYGMHWVRQAPGKGLEWVAVISYDGNDKYYADSVKGRFTISRDNSKKTLYLQMDSLRAEDTAVYYCAKEGAYCGGDCFSSWGQGTLVTVSS

SEQ ID NO: 1768 - protein, 103 aa, Artificial Sequence
  Description of Artificial Sequence: Synthetic light chain variable region amino acid sequence
GIQLTQSPSSLSASVGDRVTITCRASQSSSSYLNWYQQKPGKAPKLLIYAASSLQSGVPSRFSGSGSGTDFTLTISSLQPEDFATYYCQQSYSFGGGTKVEIK

SEQ ID NO: 1769 - protein, 120 aa, Artificial Sequence
  Description of Artificial Sequence: Synthetic heavy chain variable region amino acid sequence
EVQLVESGGGLVKPGGSLRLSCAASGFTFSDYSMNWVRQAPGKGLEWVSSTSSGSTYIYYADSVKGRFTISRDNGKNSLYLQMNSLRAEDTAVYYCARAFRLGYDALDIWGQGTMVTVSS

SEQ ID NO: 1770 - protein, 107 aa, Artificial Sequence
  Description of Artificial Sequence: Synthetic light chain variable region amino acid sequence
DIRMTQSPSSLSASVGDRVTIICRASQSISNYLNWYQQKPGKAPKLLIYVASNLQSGVPSRFSGSGSGTDFTLTISSLQPEDFATYYCQQTYSPPPTFGGGTKLEIK

SEQ ID NO: 1771 - protein, 125 aa, Artificial Sequence
  Description of Artificial Sequence: Synthetic heavy chain variable region amino acid sequence
EVQLQESGPGLVKPSGTLSLTCAVAGGFISSGNWWSWIRQPPGKGLEWIGEVYHSGRTSYNPSLKSRVTISVDNSKNQFSLKMSSVTAADTAVYYCARVESYSSSGYYIAYFDNWGQGNLVTVSS

SEQ ID NO: 1772 - protein, 107 aa, Artificial Sequence
  Description of Artificial Sequence: Synthetic light chain variable region amino acid sequence
DIVLTQSPSSLSASVGDRVTITCRASQSISRYLSWYQQKPGKAPKLLIYAAFSLQTGVPSRFSGSGSGTDFTLTISSFQTEDSATYYCQQSYSAPVTFGGGTKVEIK

SEQ ID NO: 1773 - protein, 122 aa, Artificial Sequence
  Description of Artificial Sequence: Synthetic heavy chain variable region amino acid sequence
QVQLQQWGPGLVKPSETLSLSCAVSGGSLRGHFWSWIRQPPGKGLEWIGEINHGGRTNFNPSLKSRLTISEDSSKNQFSLKLSSVTAADTAVYYCARRWGYDSSGYYFFDYWGQGTLVTVSS

SEQ ID NO: 1774 - protein, 106 aa, Artificial Sequence
  Description of Artificial Sequence: Synthetic light chain variable region amino acid sequence
EIQMTQSPATLSVSPGERATLSCRASQTLGFNLAWYQQKPGQSPRLLIYGASTRATGIPARFSGSGAGTEFTLTISSLQSEDFAVYFCQQYSNYYTFGQGTKVEIK

SEQ ID NO: 1775 - protein, 128 aa, Artificial Sequence
  Description of Artificial Sequence: Synthetic heavy chain variable region amino acid sequence
EVQLVQSGAEVKKPGSSVKVSCKASGGTFSRNAISWVRQAPGQGLEWMGGIIPIFGAANYPQKFQGRVTITADKSTSTAYMELSSLRSEDTALYYCARTMGEMTTTPVSIYYYGMDVWGQGTTVTVSS

SEQ ID NO: 1776 - protein, 111 aa, Artificial Sequence
  Description of Artificial Sequence: Synthetic light chain variable region amino acid sequence
QSVLTQPPSVSAAPGQKVTISCSGSSSNIGINYVSWYQQLPGTAPKLLIYDNNKRPSGIPDRFSGSKSGTSATLGITGLQTGDEADYYCGTWDSSLSAGYVFGSGTKLTVL

SEQ ID NO: 1777 - protein, 123 aa, Artificial Sequence
  Description of Artificial Sequence: Synthetic heavy chain variable region amino acid sequence
QVQLVQSGAEVKKAGESLKISCKGPRHSFTSYWIGWVRQMPGKGLEWMASIYPGDSDSRYSPSFEGQVTISADKSIDTAFLQWSSLKASDTAMYFCARYVGAVPGGNWYFDLWGRGTLVTVSS

SEQ ID NO: 1778 - protein, 109 aa, Artificial Sequence
  Description of Artificial Sequence: Synthetic light chain variable region amino acid sequence
SYELIQLPSVSVSPGQTARITCSGDALPKKYAYWYQQKSGQAPVLVIYDDNKRPSGIPARFSGSSSGTMATLTISGAQVEDEGDYYCYSTDSTGDHRGVFGGGTKLTVL

SEQ ID NO: 1779 - protein, 122 aa, Artificial Sequence
  Description of Artificial Sequence: Synthetic heavy chain variable region amino acid sequence
EVQLVQSGDEVKKPGASVKVSCKASGYPFSTYGISWVRQAPGQGLEWMGWIGVYTGGTNYAQKFQGRVTLTTDTSTSTAYMELRSLRSDDTAVYYCARGTGSYMTATYFDYWGQGTLVTVSS

SEQ ID NO: 1780 - protein, 107 aa, Artificial Sequence
  Description of Artificial Sequence: Synthetic light chain variable region amino acid sequence
SYELTQPPSVSVAPGQTARITCGGNNIGSKAVHWYQQKPGQAPVLVVYDDYDRPSGIPERFSGSNSGNTATLTISRVEAGDEADYYCQVWDSSSDYVFGTGTKLTVL

SEQ ID NO: 1781 - protein, 126 aa, Artificial Sequence
  Description of Artificial Sequence: Synthetic heavy chain variable region amino acid sequence
QVTLKESGPALVKPTQTLTLTCTFSGFSLSTSRMCVSWIRQPPGKALEWLARIDWDGDIYYSTSLRTRLTISKDTSKNQVVLTMTNMDPVDTATYYCARTSIYATGGYYLYYSDYWGQGTLVTVSS

SEQ ID NO: 1782 - protein, 107 aa, Artificial Sequence
  Description of Artificial Sequence: Synthetic light chain variable region amino acid sequence
EIVMTQSPSSLSASVGDRVTITCRASQSIASYVNWFQQKPGKAPKLLIYAASNVHSGVPSRFSGSGSGTGFTLTISSLQPEDSAIYYCQQSYTTPWTFGQGTKLEIK

SEQ ID NO: 1783 - protein, 125 aa, Artificial Sequence
  Description of Artificial Sequence: Synthetic heavy chain variable region amino acid sequence
EVQLVESGGGVVQPGGSLRLSCAASGFTFRTYGMHWVRQAPGKGLEWVAVISYDGSNKYYADSLMGRFTISRDNSKNTLYLQMNSLRAEDTAVYYCAKCFVPGSGGWYEYYFDYWGQGTLVTVSS

SEQ ID NO: 1784 - protein, 111 aa, Artificial Sequence
  Description of Artificial Sequence: Synthetic light chain variable region amino acid sequence
QSVLTQPPSASGSPGQSVTISCTGTSSDVGGYNYVSWYQQHPGKAPKLMIYEVSKRPSGVPDRFSGSKSGNTASLTVSGLQAEDEADYYCSSYAGINNSVLFGGGTKLTVL

SEQ ID NO: 1785 - protein, 120 aa, Artificial Sequence
  Description of Artificial Sequence: Synthetic heavy chain variable region amino acid sequence
QVQLVQSGAEVKKPGESLRISCKGSGYSFSSHWIGWVRQKPGKGLEWMGIIYPGDSDTRYSPSFQGHVTISADKSISTAYLRWSSLKASDTAIYYCAKRMVGDYYGMNLWGQGTTVTVSS

SEQ ID NO: 1786 - protein, 108 aa, Artificial Sequence
  Description of Artificial Sequence: Synthetic light chain variable region amino acid sequence
EIVMTQSPSSLSASVGDRVTITCQASQDISNRLNWYQQKPGKAPKLLIYDASNLETGVPSRFSGSGSGTDFTFTISSLQPEDIATYFCQQYDYLLWFTFGPGTKVDIK

SEQ ID NO: 1787 - protein, 120 aa, Artificial Sequence
  Description of Artificial Sequence: Synthetic heavy chain variable region amino acid sequence
QVQLVQSGAEVKKPGESLKISCQASGYSFTTYWIGWVRQTPGKGLEWMGIIYPGDSDTRYTPSFQGQVTISADKSISTAYLHWSSLKASDTAMYYCARLSGGYTFGFDYWGLGTLVTVSS

SEQ ID NO: 1788 - protein, 110 aa, Artificial Sequence
  Description of Artificial Sequence: Synthetic light chain variable region amino acid sequence
NFMLTQPHSVSESPGKTVTISCTRSSGNIARYYVQWYQQRPGRAPTTVIYEDDQRPSGVPDRFSGSIDRSSNSASLTISGLKTEDEADYYCQSYDASNYVFATGTKVTVL

SEQ ID NO: 1789 - protein, 127 aa, Artificial Sequence
  Description of Artificial Sequence: Synthetic heavy chain variable region amino acid sequence
EVQLLESGSGLVKPLQTLSLTCAVSGGSISSGGYSWSWIRQPPGKGLEWIGYIYPSGSTYYNPSLKSRVTMSIDRSKNQFSLRLTSVTAADTAVYYCARGDGNDFWSADSSHAFAIWGQGTMVTVSS

SEQ ID NO: 1790 - protein, 108 aa, Artificial Sequence
  Description of Artificial Sequence: Synthetic light chain variable region amino acid sequence
EIVMTQSPGTLSLSPGERATLSCRASQIVGNSYLAWYQQKPGQAPRLLIYGASSRATGIPERFSGSGSGTDFTLTISRLEPEDFAVYHCQQYGSSPWTFGQGTKVEIK

SEQ ID NO: 1791 - protein, 126 aa, Artificial Sequence
  Description of Artificial Sequence: Synthetic heavy chain variable region amino acid sequence
QVQLVESGGGVVQPGRSLRLSCAASGFTFSSYGMHWVRQAPGKGLEWVSVIWFDGSKKYYEDSVKGRFTISRDNSKNTLYLEMNSLRAEDTAVYYCAREAPVRLGELSLYGYFDYWGQGTLVTVSS

SEQ ID NO: 1792 - protein, 107 aa, Artificial Sequence
  Description of Artificial Sequence: Synthetic light chain variable region amino acid sequence
DIQMTQSPSTLSASVGDRVTITCRASQSFSSWLAWYQQKPGKAPKLLIYDASTLESGVPSRFSGSGSGTEFTLTISSLQPDDFATYYCQQYNSYSWTFGQGTKLEIK

SEQ ID NO: 1793 - protein, 121 aa, Artificial Sequence
  Description of Artificial Sequence: Synthetic heavy chain variable region amino acid sequence
QVQLQESGPGLVKPSQTLSLTCTVSGGSMISGDFYWSWIRQPPGKGLEWIGYIYYSGTTYYSPSLKSRVSMSIDTSKSQFSLKLSSVTAADTAVYYCARKYSYGEKAYHYWGQGTLVTVSS

SEQ ID NO: 1794 - protein, 108 aa, Artificial Sequence
  Description of Artificial Sequence: Synthetic light chain variable region amino acid sequence
EIVLTQSPGTLSLSPGERATLSCRASQTVGNNYLAWYQQKPGQAPRLLIYGASSRATGIPDRFSGSGSGTDFTLTISRLESEDFAVYHCHQYGTSPQTFGQGTKVEIK

SEQ ID NO: 1795 - protein, 131 aa, Artificial Sequence
  Description of Artificial Sequence: Synthetic heavy chain variable region amino acid sequence
EVQLVESGSGLVKPSQTLSLTCSVSGGSISSGGYSWSWIRQPPGKGLEWIGFIYNTGSTYSNPSLKSRLTLSVDRSNNRFSLKLNSVTAADTGVYFCARSGNVRQCDATGHCSTNYYFEYWGLGTLVTVSS

SEQ ID NO: 1796 - protein, 108 aa, Artificial Sequence
  Description of Artificial Sequence: Synthetic light chain variable region amino acid sequence
EIVMTQSPATLSVSPGERATLSCRASQSVSSNLAWYQQKPGQAPRLLIYGASTRATGIPARFSGSGSGTEFTLTISSLQSEDFAVYYCQQHDDWPPLTFGGGTKVEIK

SEQ ID NO: 1797 - protein, 126 aa, Artificial Sequence
  Description of Artificial Sequence: Synthetic heavy chain variable region amino acid sequence
EVQLLESGGGVVQPGRSLRLSCAASGLSFNSFGMHWVRQAPGKGLEWVAVIAYDGSNKYYADSVKGRFSISRDNSKNTLYLQMDSLRAEDTAVYYCAKAEAPNFSWSGYLSAFDIWGQGTTVTVSS

SEQ ID NO: 1798 - protein, 110 aa, Artificial Sequence
  Description of Artificial Sequence: Synthetic light chain variable region amino acid sequence
QPVLTQPASVSGSPGQSVTVSCTGTSDDVGDYNYVSWYQQHPGKAPKLLIFEVSDRPSGVSTRFSGSKSGNTASLTISGLQTEDEADYYCSSYTSRNLYVFGTGTKVTVL

SEQ ID NO: 1799 - protein, 122 aa, Artificial Sequence
  Description of Artificial Sequence: Synthetic heavy chain variable region amino acid sequence
EVQLVESGGGLVQPGRSLRLSCAASGFTFGDYAMHWVRQAPGKGLEWVSGITWNSGRVVYADSVKGRFTISRDNAKNSLYLQINSLRAEDTALYYCVKGSCNGGICYSADYWGQGTLVTVSS

SEQ ID NO: 1800 - protein, 110 aa, Artificial Sequence
  Description of Artificial Sequence: Synthetic light chain variable region amino acid sequence
NFMLTQPHSVSESPGKTVTISCTRSSGSIARNFVHWYQQRPGSSPTTVIYEDNQRPSGVPGRFSGSIDSSSNSASLTISGLRSEDEADYYCQSYDSDNWVFGGGTKLTVL

SEQ ID NO: 1801 - protein, 125 aa, Artificial Sequence
  Description of Artificial Sequence: Synthetic heavy chain variable region amino acid sequence
EVQLLESGGGLVEPGTSLRLSCEASGFTFSDYYMSWIRQAPGKGPEWVADISSRGVVTYYADSVKGRFTISRDNAKNSLYLQLNSLGAEDTAVYYCARLREVTYIMPTIDYFDYWGQGTLVTVSS

SEQ ID NO: 1802 - protein, 108 aa, Artificial Sequence
  Description of Artificial Sequence: Synthetic light chain variable region amino acid sequence
SYELTQPPSVSVSPGQTARITCSGDAFVKKYAYWYHQKSGQAPVVVIYEDTKRPSGIPERFSGSSSGTTATLTISGAQVEDEGDYYCYSRDFSGDHGVFGGGTKLTVL

SEQ ID NO: 1803 - protein, 125 aa, Artificial Sequence
  Description of Artificial Sequence: Synthetic heavy chain variable region amino acid sequence
QVQLVESGGGQGQPGRSLRLSCAASGFTFDDYAMHWVRQVPGKGLEWVSGINWNSGYIGYADSVKGRFTISRDNAKNSLYLQMNSLRAEDTALYYCAKANNPIDSSGYNRGFDTWGQGTLVTVSS

SEQ ID NO: 1804 - protein, 110 aa, Artificial Sequence
  Description of Artificial Sequence: Synthetic light chain variable region amino acid sequence
QSALTQPRSVSGSPGQSVTISCTGTSSDVGGYNYVSWYQQHPGKAPKLMIYDVNKRPSGVPDRFSGSKSDNTASLTISGLQAEDESDYFCCSYAGTYTWVFGGGTKVTVL

SEQ ID NO: 1805 - protein, 125 aa, Artificial Sequence
  Description of Artificial Sequence: Synthetic heavy chain variable region amino acid sequence
QVQLVQSGAEVRKPGASVKVSCKAFGYTFTNFAISWVRQAPGQGLEWMGWIGPYNGDTDYEQKFQGRVTMTADTSSSTVFMELRSLRFDDTAVYYCARGKGSTIPLGYYIGMDVWGQGTTVTVSS

SEQ ID NO: 1806 - protein, 107 aa, Artificial Sequence
  Description of Artificial Sequence: Synthetic light chain variable region amino acid sequence
ETTLTQSPSSLSASVGDRVTMTCRASQGISNYLAWYQQKPGKPPKLLIYLASSLQSGVPSRFSGSGSGTDFTLTISSLQPEDVATYYCQKYNSAPLTFGGGTKLEIK

SEQ ID NO: 1807 - protein, 120 aa, Artificial Sequence
  Description of Artificial Sequence: Synthetic heavy chain variable region amino acid sequence
QVQLVQSGDEVKKPGASVKVSCKSSGYTFTHFGVSWVRQAPGQGLEWMGWISGYNGNTNYAQKLQGRVTMTTDTSTTTAYMELTSLRSDDTAVYYCARDSPAGTVTLDFWGQGTTVTVSS

SEQ ID NO: 1808 - protein, 114 aa, Artificial Sequence
  Description of Artificial Sequence: Synthetic light chain variable region amino acid sequence
DIVMTQSPLSLPVTLGQPASISCRSSQSLVYSDGNTYLNWFQQRPGQSPRRLIYKVSNRDSGVPDRFSGSGSGTDFTLKISRVEAEDVGVYYCMHGTHWPPEYTFGQGTKVEIK

SEQ ID NO: 1809 - protein, 131 aa, Artificial Sequence
  Description of Artificial Sequence: Synthetic heavy chain variable region amino acid sequence
EVQLLESGGGVVQPGRSLRLSCAASGFTFSSSGMHWVRQAPGKGLEWVAIISSDGSKHYYADSVKGRFTISRDNSKNTLYLEMNSLRAEDSAVYYCAREGVWSGFFVDTGTDFRHHGMDVWGQGTTVTVSS

SEQ ID NO: 1810 - protein, 108 aa, Artificial Sequence
  Description of Artificial Sequence: Synthetic light chain variable region amino acid sequence
SYELTQPPSVSVSPGQTARITCSGDALPKKFAFWYQQKSGQAPLLVIHEDNKRPSGIPERFSGSSSGTLATLTISGAQVEDEADYYCYSIDTSANLGVFGGGTKLTVL

SEQ ID NO: 1811 - protein, 121 aa, Artificial Sequence
  Description of Artificial Sequence: Synthetic heavy chain variable region amino acid sequence
QVQLVQSGAEVKKPGASVKVSCQASGYTLTTYDINWVRQAPGQGLEWMGWMNANSGNTGYAQKFQGRVTMTRNISISTAYMELSSLGPEDTAVYYCARGFYKWNDWSFDYWGQGTLVTVSS

SEQ ID NO: 1812 - protein, 109 aa, Artificial Sequence
  Description of Artificial Sequence: Synthetic light chain variable region amino acid sequence
QSVLTQPPSVSVAPGQTARITCGGNNIGSKSVHWYQQKPGQAPVLVVYDDSDRPSGIPERFSGSNSGNTAPLTISRVEAGDEADYYCQVWDGDSAHHAVFGGGTQLTVL

SEQ ID NO: 1813 - protein, 121 aa, Artificial Sequence
  Description of Artificial Sequence: Synthetic heavy chain variable region amino acid sequence
QVQLVQSGAEVKKPGSSVKVSCKASGGTFSNYGISWVRQAPGQGLERLGGIIPIYGTANHAQNFQGRVTITADESTSTAYMELSSLRSEDTAVYYCARDGTFVRYYGMDVWGQGTTVTVSS

SEQ ID NO: 1814 - protein, 107 aa, Artificial Sequence
  Description of Artificial Sequence: Synthetic light chain variable region amino acid sequence
EIVLTQSPATLFLSPGERATLSCRASQSVSNYLAWFQQKPGQAPRLLIYDTSIRATGIPARFSGSGSGTDFTLTISSLEPEDFAFYYCQQRSNWPPTFGGGTKLEIK

SEQ ID NO: 1815 - protein, 121 aa, Artificial Sequence
  Description of Artificial Sequence: Synthetic heavy chain variable region amino acid sequence
QVQLVQSGGGLVKHGGSLRLSCAASGFTFSSYSMNWVRQAPGKGLEWASSISSSSSYIYYADSVKGRFTISRDNAKNSLYLQMNSLRAEDTAVYYCARTEYSSSSPIFDYWGQGTLVTVSS

SEQ ID NO: 1816 - protein, 111 aa, Artificial Sequence
  Description of Artificial Sequence: Synthetic light chain variable region amino acid sequence
QSVLTQPPSVSGAPGQRVTISCTGSSSNIGAGYDVHWYQQLPGTAPKLLTYGNSNRPSGVPDRFSGSKSGTSASLAITGLQAEDEADYYCQSYDSSLSGSVFGGGTKVTVL

SEQ ID NO: 1817 - protein, 133 aa, Artificial Sequence
  Description of Artificial Sequence: Synthetic heavy chain variable region amino acid sequence
EVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGTRTIVYCDGDCYQPWAYHYYGMDVWGQGTTVTVSS

SEQ ID NO: 1818 - protein, 110 aa, Artificial Sequence
  Description of Artificial Sequence: Synthetic light chain variable region amino acid sequence
QSVVTQEPSVSAAPGQKVTISCSGGSSNIGNNYVSWYQHLPGTAPKLLIYDNDKRPSGIPDRFSGSKSGTSATLGITGLQTGDEADYYCGTWDSSLSAVVFGGGTKLTVL

SEQ ID NO: 1819 - protein, 129 aa, Artificial Sequence
  Description of Artificial Sequence: Synthetic heavy chain variable region amino acid sequence
QVQLVQSGAEVKKPGSSVKVSCQASGGTFSTHALSWVRQTPGHGLEWVGGVLPVFGATKYPRKFQGRVTITADKSTNTAYMELSSLRSDDTAVYYCARVVVHSTITTAKDFFSGVHDIWGQGTMVTVSS

SEQ ID NO: 1820 - protein, 108 aa, Artificial Sequence
  Description of Artificial Sequence: Synthetic light chain variable region amino acid sequence
DIRMTQSPSTLSASVGDRVTITCRASQTVSSWLAWYQQKPGKAPKLLIYQASSLESGVPSRFSGSGSGTEFTLTISGLQPDDFATYFCQHYNSYSPVTFGGGTKVEIK

SEQ ID NO: 1821 - protein, 115 aa, Artificial Sequence
  Description of Artificial Sequence: Synthetic heavy chain variable region amino acid sequence
QVQLVQSGAEVKKPGASVKVSCKASGYTFTDYYMHWVRQAPGQGLEWLAWINPYTGGTNYAQKFQGRVTLTRDTSVSTTYMEVTRLRSDDTAVYYCARGESFHHWGQGTLVTVSS

SEQ ID NO: 1822 - protein, 112 aa, Artificial Sequence
  Description of Artificial Sequence: Synthetic light chain variable region amino acid sequence
QSALTQPASVSGSPGQSITISCTGTSSDIGGYDYVSWYQQHPGKVPKLMIYEVSTRPSGVSIRFSGSKSGNTASLTISGLQAEDEADYYCSSYTRSTITSVVFGGGTKLTVL

SEQ ID NO: 1823 - protein, 135 aa, Artificial Sequence
  Description of Artificial Sequence: Synthetic heavy chain variable region amino acid sequence
RCTLQQWGAGRVKPSETLSLTCAVYRGPFSGYYWSWIRQPPGKGLEWIGEINLGETNPGGSTHYNPSLRSRLSMSIDTSKKQFSLRVNSVTAADTAVYYCTRGPVSRIYDTSGSYSLNYYGMDVWGQGTTVTVSS

SEQ ID NO: 1824 - protein, 107 aa, Artificial Sequence
  Description of Artificial Sequence: Synthetic light chain variable region amino acid sequence
DIRMTQSPSSLSASVGDRVTITCRASQGIRNDLGWYQQKPGRAPERLIYPASSLQGGVPSRFIASGSGTEFTLTISNLQPEDFATYYCLQHNSYPRTFGQGTKVEIK

SEQ ID NO: 1825 - protein, 126 aa, Artificial Sequence
  Description of Artificial Sequence: Synthetic heavy chain variable region amino acid sequence
QVQLQQWGAGLLKPSETLSLTCSVLGGSFSGYYWTWIRQPPGKGLEWIGEITHDGSSNYNPSLNSRVTISVDTSNYQFSLKMRSVTAADTAVYYCARSPDLTIFGGLYFYYGISVWGQGTTVTVSS

SEQ ID NO: 1826 - protein, 107 aa, Artificial Sequence
  Description of Artificial Sequence: Synthetic light chain variable region amino acid sequence
DIQMTQSPSSLSASMGDRVTITCRASQDISNYLAWYQQKPGKVPNLLIYAASTLQGGVPSRFSGSGSGTDFTLTISSLQPEDVAIYYCQKYKSAPRTFGQGTKVEIK

SEQ ID NO: 1827 - protein, 120 aa, Artificial Sequence
  Description of Artificial Sequence: Synthetic heavy chain variable region amino acid sequence
QVQLVQSGAEVKKPGESLKISCKASGYSFTSYWIAWVRQMPGKGLEWMGIIFPGDSDTRYSPSFQGQVTISADKSISTAYLQWSSLEASDTAMYYCAKSTTYYYYGLDVWGQGTTVTVSS

SEQ ID NO: 1828 - protein, 110 aa, Artificial Sequence
  Description of Artificial Sequence: Synthetic light chain variable region amino acid sequence
QPVLTQPASVSGSPGQSITISCTGTSSDVGGYDYVSWYQQYPGKAPKLMIYEVSNRPLGVSNRFSGSRSGYTASLTISGLQAEDETNYYCSSYTSSRTWVFGGGTKLTVL

SEQ ID NO: 1829 - protein, 126 aa, Artificial Sequence
  Description of Artificial Sequence: Synthetic heavy chain variable region amino acid sequence
EVQLLESGPALVKPTQTLTLTCTFSGFSLTTTRMSVSWIRQPPGKALEWLARIDWDDDKYYSTSLKTRLTISKDTSKNQVVLTMTNMDPVDTATYFCARVNVYAANGYYSYYLDYWGQGTLVTVSS

SEQ ID NO: 1830 - protein, 107 aa, Artificial Sequence
  Description of Artificial Sequence: Synthetic light chain variable region amino acid sequence
DIVMTQTPSSLSASVGDRVTITCRTSQSSSRYLNWYQKEPGKAPRLLIYLASALRSGVPSRFSGSGSGTDFTLTISSLQSEDFATYYCQQTYSIPWTFGQGTKVEIK

SEQ ID NO: 1831 - protein, 115 aa, Artificial Sequence
  Description of Artificial Sequence: Synthetic heavy chain variable region amino acid sequence
QVQLVQSGAELKKPGSSVRISCKVSGVTSDNYAITWVRQAPGQGLEWMGRVIPIFPVPQYAQKFQGRVTLSADKSTRTAYLELHSLRSEDTATYYCATHRPSDSWGQGTLVTVSS

SEQ ID NO: 1832 - protein, 107 aa, Artificial Sequence
  Description of Artificial Sequence: Synthetic light chain variable region amino acid sequence
DIRVTQSPSTLSASVGDRVTITCRASQNINSWLAWYQQKPGKAPKLLIFKASSLESGVPARFSGSGFGTEFTLTITSLQPDDFASYYCQQYDTYPYPFGQGTKVEIK

SEQ ID NO: 1833 - protein, 126 aa, Artificial Sequence
  Description of Artificial Sequence: Synthetic heavy chain variable region amino acid sequence
QVTLKESGGGLVQPGGSLRLSCAASGFTFSNYAMSWVRQAPGKGLEWVSAISHSDSRTFYADSVKGRFTISRDNSKNTLFLQMDSLRAHDTAVYYCANVDPSSVTYYGYYYGMDVWGQGTTVTVSS

SEQ ID NO: 1834 - protein, 110 aa, Artificial Sequence
  Description of Artificial Sequence: Synthetic light chain variable region amino acid sequence
QSVLTQPPSASGTPGQRVTISCSGSSSNIGKNFVYWYQQFPGTAPKRLIYRNNQRPSGVPDRFSGSRSGTSASLAISGLRSEDEADYYCATWDDSLSGWVFGGGTKLTVL

SEQ ID NO: 1835 - protein, 121 aa, Artificial Sequence
  Description of Artificial Sequence: Synthetic heavy chain variable region amino acid sequence
QVQLVQSGGGVVQPGRSLRLSCAASGFNFHNYAMHWVRQAPGKGLEWVAVISYDGGNKHYADSVKGRFTISRDNSKNTLYLQMNSLRPDDTAVYYCARGHSDWRGDYFDFWGQGTLVTVSS

SEQ ID NO: 1836 - protein, 108 aa, Artificial Sequence
  Description of Artificial Sequence: Synthetic light chain variable region amino acid sequence
DIQLTQSPATLSVSPGERAILSCRASQNVGTNLAWYQQKPGQAPRLLIYDASTRATGIPARFSGSGAGTDFTLTISGLQSEDFAVYYCQQYINWPPYTFGQGTKLEIK

SEQ ID NO: 1837 - protein, 127 aa, Artificial Sequence
  Description of Artificial Sequence: Synthetic heavy chain variable region amino acid sequence
QVQLQQSGPRLVKPSHTLSLTCVISGDSVSSGSAAWSWIRQSPSRGLEWLGRTYYRSKWYYDYAVSVKGRIIIQPDTSKNQFSLQLNSVSPEDTAVYYCARDPDSGNYFHYYGMDVWGQGTTVTVSS

SEQ ID NO: 1838 - protein, 108 aa, Artificial Sequence
  Description of Artificial Sequence: Synthetic light chain variable region amino acid sequence
DIVMTQSPATLSLSPGERATLSCRASQSVDVYFAWYQQKPGQAPRLLIYDASKRASGVPARFSGSASGTDFTLTISSLEPEDFAVYYCQQRAKWPPYTFGQGTKLEIK

SEQ ID NO: 1839 - protein, 125 aa, Artificial Sequence
  Description of Artificial Sequence: Synthetic heavy chain variable region amino acid sequence
EVQLVESGGGLVKPGGSLRLSCAASGFTFSSYSMNWVRQAPGKGLEWVSSISAGSSYTDYAESVKGRFTISRDNAKNSLYLKMNSLRAEDTAVYYCARDPGYCSSNSCTVAMDVWGQGTTVTVSS

SEQ ID NO: 1840 - protein, 109 aa, Artificial Sequence
  Description of Artificial Sequence: Synthetic light chain variable region amino acid sequence
SYELTQPPSVSGAPGQRVTISCTGSSSNIGAGYDVHWYQQLPGTAPKLLIYGNNNRPSGVPDRFSGSKSGTSASLAITGLQAEDEADYYCQSYDRTLVIFGGGTKLTVL

SEQ ID NO: 1841 - protein, 123 aa, Artificial Sequence
  Description of Artificial Sequence: Synthetic heavy chain variable region amino acid sequence
EVQLLESGPTLVKPTQTLTLTCTFSGFSLSTFGVGVGWIRQPPGKALECLALIYWDDDKRYSPSLKSRLTITRDTSKNQVVLTMTNMDPVDTATYYCAHRRSSTVTTGFFDYWGRGTLVTVSS

SEQ ID NO: 1842 - protein, 111 aa, Artificial Sequence
  Description of Artificial Sequence: Synthetic light chain variable region amino acid sequence
QPVLTQPPSVSGAPGQRVTVSCTGNSSNIGAGHGAHWYQQLPGTAPKLLIYGSTDRPSGVPDRFFGSQSGTSASLVITELRAEDEADYYCQSFDSSLSIWVFGGGTKLTVL

SEQ ID NO: 1843 - protein, 121 aa, Artificial Sequence
  Description of Artificial Sequence: Synthetic heavy chain variable region amino acid sequence
EVQLLESGGGLVKPGGSLRLSCGASGFTFSTSSFNWVRQAPGKGLEWVSSISSTSSYVFYADSVKGRFTVSRDNAQNSLYLQMNSLRAEDTAVYYCARARGVGATIGFDYWGQGTLVTVSS

SEQ ID NO: 1844 - protein, 112 aa, Artificial Sequence
  Description of Artificial Sequence: Synthetic light chain variable region amino acid sequence
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 1845 - protein, 128 aa, Artificial Sequence
  Description of Artificial Sequence: Synthetic heavy chain variable region amino acid sequence
QVQLVQSGAEVKKPGASVKVSCEASGYTFTDSYIHWVRQAPGQGLEWMGWINPNSGGTNYAQKFQGRVTMTRDTSTSTAFIELSRLRSDDTAVYYSARGVRQQWLVNTGDPDYYFDFWGQGTLVTVSS

SEQ ID NO: 1846 - protein, 106 aa, Artificial Sequence
  Description of Artificial Sequence: Synthetic light chain variable region amino acid sequence
SYVLTQPPSVSVSPGQTASITCSGDKLGDKYSCWYQQKPGQSPVLVIYQDYKRPSGIPERFSGSNSGNTATLTISGTQAMDEADYYCQAWDRNAGVFGTGTKLTVL

SEQ ID NO: 1847 - protein, 122 aa, Artificial Sequence
  Description of Artificial Sequence: Synthetic heavy chain variable region amino acid sequence
QVQLVQSGAEVKKPGESLKISCKGPGYSFTTYWIGWVRQMPGKGLEWMGIIYPGDSDTKYSPSFQGQVTITADKSIATAYLQWSRLKASDTAVYYCATVVTYADNIRWFDSWGQGTLVTVSS

SEQ ID NO: 1848 - protein, 110 aa, Artificial Sequence
  Description of Artificial Sequence: Synthetic light chain variable region amino acid sequence
QSALTQPASVSGSPGQSITISCTGTSGDVGGYKFVSWYQHHPGKAPKLVIYDVANRPSGVSDRFSGSKSGTTASLTISGLQAEDEADYYCSSYTSSSTYVFGTGTKVTAL

SEQ ID NO: 1849 - protein, 123 aa, Artificial Sequence
  Description of Artificial Sequence: Synthetic heavy chain variable region amino acid sequence
EVQLVESGGGLVQPGGSLRLSCAASGFTVNTNYMSWVRQAPGKGLEWVSIIYSSGSTSYADSVKGRFTISRDNSENTLYLQMHTLRAEDTAVYYCVRERTPFYYVSSGYWDSWGQGTLVTVSS

SEQ ID NO: 1850 - protein, 107 aa, Artificial Sequence
  Description of Artificial Sequence: Synthetic light chain variable region amino acid sequence
EIVLTQSPGTLSLSPGERATLSCRASQSVDSSYLAWYQQKPGQAPRLLIFGASSRATGIPDRFSGSGSGTDFTLTISRLEPEDFAVYYCQQYGFSYTFGQGTKVEIK

SEQ ID NO: 1851 - protein, 130 aa, Artificial Sequence
  Description of Artificial Sequence: Synthetic heavy chain variable region amino acid sequence
EVQLVESGGGVVQPGRSLRLSCAVSGFTFSTYGMHWVRQTPGRGLEWVAVISYDGNHKYYADSVMGRFTISRDNSKDTLYLQVNSLRPEDSAVYYCAKDRIHCPNGVCYVHSSFYGLDVWGQGTTVTVSS

SEQ ID NO: 1852 - protein, 110 aa, Artificial Sequence
  Description of Artificial Sequence: Synthetic light chain variable region amino acid sequence
QTVVTQEPSLTVSPGGTVTLTCGSSTGAVTSGHYPYWLQQKPGQAPRTLIYDTTNKDSWTPARFSGSLLGGKAALTLSGAQPEDEAQYYCLLSFNGPYWVFGGGTKVTVL

SEQ ID NO: 1853 - protein, 130 aa, Artificial Sequence
  Description of Artificial Sequence: Synthetic heavy chain variable region amino acid sequence
EVQLSESAGGVVQPGGSLRLTCAASGFSFSTNGMHWVRQAPGKGLEWVAFIRYDGSKKYYAESVKGRFTISREDSNNTLYLQMNSLRPEDTAVYYCAKEDCSGGTCYHERNYYYYGMDVWGQGTTVTVSS

SEQ ID NO: 1854 - protein, 106 aa, Artificial Sequence
  Description of Artificial Sequence: Synthetic light chain variable region amino acid sequence
QPVLTQPPSLPVSPGQTASITCSGDKLEYKYACWYQHKPGQSPVLVIYQDNKRPSGIPERFSGSNSGNTATLTISGTQPMDEADYYCQAWDSSTVVFGGGTKVTVL

SEQ ID NO: 1855 - protein, 124 aa, Artificial Sequence
  Description of Artificial Sequence: Synthetic heavy chain variable region amino acid sequence
EVQLVESGGGLVQPGGSLRLSCADSDFTFSTYSMNWVRQAPGKGLEWISYITGRSSAIYYADSVKGRFTISRDNAKNSLFLQMNSLRAEDTAVYYCTTFMAGYSFGHGDAFDIWGQGTTVTVSS

SEQ ID NO: 1856 - protein, 110 aa, Artificial Sequence
  Description of Artificial Sequence: Synthetic light chain variable region amino acid sequence
SYELTQPPSVSVAPGQTARITCGGNNIGSKSVHWYQQKPGQAPVLVVYDDSDRPSGIPERFSGSNSGNTATLTISRVEAGDEADYYCQVWNSNSDHPHWVFGGGTQLTVL

SEQ ID NO: 1857 - protein, 119 aa, Artificial Sequence
  Description of Artificial Sequence: Synthetic heavy chain variable region amino acid sequence
EVQLVESGGGLVKPGGSLRLSCAASGFTSSGYNMNWVRQAPGKGLEWVSSISGSSSYIHYADSVKGRFTISRDNAKNSLYLQMNSLRAEDTAVYYCATVGALPGHFDNWGQGTLVTVSS

SEQ ID NO: 1858 - protein, 110 aa, Artificial Sequence
  Description of Artificial Sequence: Synthetic light chain variable region amino acid sequence
QAVVTQEPSVSGAPGQRVTISCTGSSSNIGAGYDVHWYQQLPGTAPKLLIYDNTNRPSGVPDRFSGSKSGTSASLAITGLQAEDEADYYCQSYDSRLTYVFGTGTKVTVL

SEQ ID NO: 1859 - protein, 129 aa, Artificial Sequence
  Description of Artificial Sequence: Synthetic heavy chain variable region amino acid sequence
QVQLVQSGPAVKKPGASVKVSCKASGYIFTSYGVSWVRQAPGQGLEWMGWISGYNGNTDYAQKFQGRVTLTVDSSTGTVYMDLRSLRSDDTAIYYCARAPPLPGQVYDGAGSYLLHGYWGQGTLVTVSS

SEQ ID NO: 1860 - protein, 112 aa, Artificial Sequence
  Description of Artificial Sequence: Synthetic light chain variable region amino acid sequence
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIK

SEQ ID NO: 1861 - protein, 124 aa, Artificial Sequence
  Description of Artificial Sequence: Synthetic heavy chain variable region amino acid sequence
EVQLLESGGGLVKPGGSLRLSCAASGFTFSSYAMHWVRQPPGKGLEWVSSISASSSFINYADSVKGRFTISRDGARNSLYLQMNSLRAEDTAVYYCVREDYDSSGYGLHWFDPWGQGTTVTVSS

SEQ ID NO: 1862 - protein, 111 aa, Artificial Sequence
  Description of Artificial Sequence: Synthetic light chain variable region amino acid sequence
SYVLTQPPSVSGAPGQRVTISCTGSSSNIGAGYDVHWYQQFPGTAPKLLMYGNTNRPSGVPDRFSGSKSGTSASLAITGLQAEDEADYYCQSYDRSLSGWVFGGGTKLTVL

SEQ ID NO: 1863 - protein, 123 aa, Artificial Sequence
  Description of Artificial Sequence: Synthetic heavy chain variable region amino acid sequence
EVQLVESGGGLVQPGGSLRLSCAASGFTFSKYAMNWVRQAPGKGLEWVSSISDSGDSRYYADSVKGRFTISRDSSKNTLNLQMNSLRAEDTAVYYCAKAGWELFSPQGAFDLWGQGTMVTVSS

SEQ ID NO: 1864 - protein, 108 aa, Artificial Sequence
  Description of Artificial Sequence: Synthetic light chain variable region amino acid sequence
EIVMTQSPGTLSLSPGERATLSCRASQSVSSSHLAWYQQKPGQAPRLLIYGASSRDSGIPDRFSGSGSGTDFTLSISRLEPEDFAVYYCQHYGNSPYTFGQGTKVDIK

SEQ ID NO: 1865 - protein, 127 aa, Artificial Sequence
  Description of Artificial Sequence: Synthetic heavy chain variable region amino acid sequence
EVQLLESGGGLVQPGGSLRLSCAASRFTFSTYAMSWVRQAPGKGLEWVSSISGSGDKTFYTDSVKGRFTISRDNSKNTLYLQMNSLRAEDTAVYYCARESYYELWTGTYPGWELDYWGQGTLVTVSS

SEQ ID NO: 1866 - protein, 107 aa, Artificial Sequence
  Description of Artificial Sequence: Synthetic light chain variable region amino acid sequence
DIQLTQSPSSLSASVGDRVTITCRASQDISNYLAWYQQKPGKPPKLLIYAASILESGAPSRFSGSGSGTDFTLTISSLQPEDVGTYYCQKSNSAPRPFGQGTKVEIK

SEQ ID NO: 1867 - protein, 119 aa, Artificial Sequence
  Description of Artificial Sequence: Synthetic heavy chain variable region amino acid sequence
EVQLLESGGRLVQPGRSLRLSCAASGFTVSGSYMSWVRQAPGKGLEWVSVIYIDGGTKYADSVKGRFTISRDNSKNTVYLQMNSLRAEDTAVYYCARDSSLWYRGGDYWGQGTLVTVSS

SEQ ID NO: 1868 - protein, 107 aa, Artificial Sequence
  Description of Artificial Sequence: Synthetic light chain variable region amino acid sequence
DIQMTQSPSSLSASVGDRVTITCQANHDISNYLNWYQQKPGKAPKLLIYDASILEAGVPSRFSGSGSGTHFTFTISSLQPEDIATYYCQQFDFRALTFGGGTKVEIK

SEQ ID NO: 1869 - protein, 129 aa, Artificial Sequence
  Description of Artificial Sequence: Synthetic heavy chain variable region amino acid sequence
EVQLLESGGGLVQPGGSLRLSCAASGFTFSSYAMNWVRQAPGKGLEWVSIISDSGGSTYYADSVKGRFTISRDNSKNTLYLQMNSLRAEDTAVYYCAKATPLKWELLIGSTPGYYFDYWGQGTTVTVSS

SEQ ID NO: 1870 - protein, 106 aa, Artificial Sequence
  Description of Artificial Sequence: Synthetic light chain variable region amino acid sequence
SYELTQLPSVSVSPGQTASITCSGDKLGDKYACWYQQKPGQSPVVIMYQDNKRPSGIPERFSGSNSGNTATLTISGTQAMDEADYYCQAWDSSTGVFGGGTKVTVL

SEQ ID NO: 1871 - protein, 123 aa, Artificial Sequence
  Description of Artificial Sequence: Synthetic heavy chain variable region amino acid sequence
EVQLLESGAEVKKPGASVKVSCRASGYTFTSNTLHWVRQAPGQGLEWMGWINADNGNTRYSQKFQGRVTITRDTSANTAYMELSSLISEDTAVYYCAREWSGFWSGLNWFEPWGQGTLVTVSS

SEQ ID NO: 1872 - protein, 111 aa, Artificial Sequence
  Description of Artificial Sequence: Synthetic light chain variable region amino acid sequence
QSVLTQPPSVSGAPGQRVTISCTGSSSNIGSGNDVHWYQQFPGTAPKVLIYVNSIRPSGVSDRFSGSKSGTSASLAITGLRAEDEADYYCQSYDSSLNGVAFGGGTKLTVL

SEQ ID NO: 1873 - protein, 129 aa, Artificial Sequence
  Description of Artificial Sequence: Synthetic heavy chain variable region amino acid sequence
QVQLVQSGAEVKKPGASVKVSCKASGYTFTSYGISWVRQAPGQGLEWMGWISAYSGDTDYAQKLQGRVTMTTDTATSTAYMELRSLRSDDTAVYYCARDAHCSSTNCYIDLGGAPVDYWGQGTLVTVSS

SEQ ID NO: 1874 - protein, 112 aa, Artificial Sequence
  Description of Artificial Sequence: Synthetic light chain variable region amino acid sequence
DIVLTQTPLSLSVTLGQPASISCRSSQSLVYIDGYTYLNWFQQRPGQSPRRLIYKVSNRDSGVPDRFSGSGSGTDFTLKISRVEAEDVGVYYCMQGAHWPWTFGQGTKVEIK

SEQ ID NO: 1875 - protein, 127 aa, Artificial Sequence
  Description of Artificial Sequence: Synthetic heavy chain variable region amino acid sequence
EVQLLESGGGVVQPGRSLRLSCAASEFTFRSYAMHWVRQAPGMGLEWVAVTPYDGISKYYADSVKGRFTISRDNSKNTLYLQMNSLRPEDTAVYYCARGFPEPITSWPGYFYAMDVWGQGTTVTVSS

SEQ ID NO: 1876 - protein, 111 aa, Artificial Sequence
  Description of Artificial Sequence: Synthetic light chain variable region amino acid sequence
QSALTQPASVSGSPGQSITISCTGTTSDVGVYNYVSWYQQHPGKAPKLMIYDVSNRPSGVSNRFSGSKSGNTASLTISGLQAEDEADYYCSSYTNSDTPVVFGGGTKLTVL

SEQ ID NO: 1877 - protein, 120 aa, Artificial Sequence
  Description of Artificial Sequence: Synthetic heavy chain variable region amino acid sequence
EVQLLESGGGVVQPGGSLRLSCVASGFTFSAYGMHWVRQAPGKGPEWVAMTRSDGNKIYYADSVKGRFTISRDDSKNTLYLEMNSLRPDDTAVYFCAKEVGYGGNSLHYWGQGTLVTVSS

SEQ ID NO: 1878 - protein, 108 aa, Artificial Sequence
  Description of Artificial Sequence: Synthetic light chain variable region amino acid sequence
SYELIQPPSVSVAPGQTAKITCGGNNIGSKSVHWYQQKPGQAPVLVVFDDSDRPSGIPERFSGSNSGNTATLTISRVEAGDEADYYCQVWDFSSDLWVFGGGTKLTVL

SEQ ID NO: 1879 - protein, 120 aa, Artificial Sequence
  Description of Artificial Sequence: Synthetic heavy chain variable region amino acid sequence
QVQLVQSGAEVKKPGSSVKVSCKASGDTFSGYAIYWVRQAPGRGLELMGGIIPILGTSSYAQRFLGRTSFTADESTSTAYMDLSSLTSADTAMYYCARKRVTVPVPFDSWGQGTLVTVSS

SEQ ID NO: 1880 - protein, 107 aa, Artificial Sequence
  Description of Artificial Sequence: Synthetic light chain variable region amino acid sequence
EIVMTQSPATLSVSPGERATLSCRASQSVSSNLAWYQQKLGQAPRLLIYGASTRATDIPARFSGSGSGTEFTLTISSLQSEDFVVYYCQQYNNWPWTFGQGTKVEIK

SEQ ID NO: 1881 - protein, 119 aa, Artificial Sequence
  Description of Artificial Sequence: Synthetic heavy chain variable region amino acid sequence
EVQLLESGGGLVKPGGSLRLSCAASGFSFSYYSMNWVRQTPGKGLEWVSSISDRSSYISYADSVKGRFTISRDNAKNSLYLQMNSLRAEDTAVYYCARDQYESYAFDIWGQGTTVTVSS

SEQ ID NO: 1882 - protein, 108 aa, Artificial Sequence
  Description of Artificial Sequence: Synthetic light chain variable region amino acid sequence
DIQVTQSPSSLSASVGDRITITCQASQDVGNYLNWYQQKVGKAPKLLIHDASDLETGVPSRFSGSGSGTYFTFTISSLQPEDFATYYCQPYDNLRPVTFGQGTRLEIK

SEQ ID NO: 1883 - protein, 125 aa, Artificial Sequence
  Description of Artificial Sequence: Synthetic heavy chain variable region amino acid sequence
QVQLVQSGAEVKKPGASVRVSCKASGYTFTHYDINWVRQAPGQGLEWMGWINPNSGDTDYAQKFQGRVTMTVDTSISTAYLDLRSLTSADAAVYYCARGGAYATNGYYIIWFDPWGQGTLVTVSS

SEQ ID NO: 1884 - protein, 107 aa, Artificial Sequence
  Description of Artificial Sequence: Synthetic light chain variable region amino acid sequence
DIVVTQSPSSLSASVGDRVTITCRASQSISRYLNWFQKKPGKAPHLLIYAASILQSEVPSRFSGSGSGTDFTLTISSLQPEDFATYYCQQSYNSPYTFGPGTKVDIK

SEQ ID NO: 1885 - protein, 127 aa, Artificial Sequence
  Description of Artificial Sequence: Synthetic heavy chain variable region amino acid sequence
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGVPVLRYFDWLRFGYGMDVWGQGTTVTVSS

SEQ ID NO: 1886 - protein, 114 aa, Artificial Sequence
  Description of Artificial Sequence: Synthetic light chain variable region amino acid sequence
EIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPLTFGGGTKLEIK

SEQ ID NO: 1887 - protein, 118 aa, Artificial Sequence
  Description of Artificial Sequence: Synthetic heavy chain variable region amino acid sequence
QVQLVQSGSELKKPGASVKVSCKASGYTFTSYAMNWVRQAPGQGLEWMGWINTNTGNPTYAQGFTGRFVFSLDTSVSTAYLQISSLKAEDTAVYYCAAYGIHDAFDIWGQGTMVTVSS

SEQ ID NO: 1888 - protein, 107 aa, Artificial Sequence
  Description of Artificial Sequence: Synthetic light chain variable region amino acid sequence
DIRLTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 1889 - protein, 121 aa, Artificial Sequence
  Description of Artificial Sequence: Synthetic heavy chain variable region amino acid sequence
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCAREGRDGYNYNFDYWGQGTLVTVSS

SEQ ID NO: 1890 - protein, 111 aa, Artificial Sequence; identical to SEQ ID NO: 876
  Description of Artificial Sequence: Synthetic light chain variable region amino acid sequence

SEQ ID NO: 1891 - protein, 124 aa, Artificial Sequence
  Description of Artificial Sequence: Synthetic heavy chain variable region amino acid sequence
EVQLVESGGGLVKPGGSLRLSCAASGFTFSDYYMSWIRQAPGKGLEWVSYISSSSSYTNYADSVKGRFTISRDNAKNSLYLQMNSLRAEDTAVYYCARDFSGQWLVLGYGMDVWGQGTTVTVSS

SEQ ID NO: 1892 - protein, 111 aa, Artificial Sequence
  Description of Artificial Sequence: Synthetic light chain variable region amino acid sequence
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGPVFGGGTKLTVL

SEQ ID NO: 1893 - protein, 122 aa, Artificial Sequence
  Description of Artificial Sequence: Synthetic heavy chain variable region amino acid sequence
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARDGADSSYYYYMDVWGKGTTVTVSS

SEQ ID NO: 1894 - protein, 111 aa, Artificial Sequence
  Description of Artificial Sequence: Synthetic light chain variable region amino acid sequence
QAVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVL

SEQ ID NO: 1895 - protein, 16 aa, Artificial Sequence
  Description of Artificial Sequence: Synthetic light chain variable region CDR1 amino acid sequence
RSSQSLLHSNGFNYLD

SEQ ID NO: 1896 - protein, 15 aa, Artificial Sequence
  Description of Artificial Sequence: Synthetic light chain variable region FR2 amino acid sequence
WYLQKPGQSPQLLIY

SEQ ID NO: 1897 - protein, 7 aa, Artificial Sequence
  Description of Artificial Sequence: Synthetic light chain variable region CDR2 amino acid sequence
LGSNRAS

SEQ ID NO: 1898 - protein, 32 aa, Artificial Sequence
  Description of Artificial Sequence: Synthetic light chain variable region FR3 amino acid sequence
GVPDRFSGSGSGTDFTLKISRVEAEDVGVYYC

SEQ ID NO: 1899 - protein, 8 aa, Artificial Sequence
  Description of Artificial Sequence: Synthetic light chain variable region CDR3 amino acid sequence
MQALQTLT

SEQ ID NO: 1900 - protein, 10 aa, Artificial Sequence
  Description of Artificial Sequence: Synthetic light chain variable region FR4 amino acid sequence
FGPGTKVEIK

SEQ ID NO: 1901 - protein, 10 aa, Artificial Sequence
  Description of Artificial Sequence: Synthetic light chain variable region FR4 amino acid sequence
FGGGTKVEIK

SEQ ID NO: 1902 - protein, 14 aa, Artificial Sequence
  Description of Artificial Sequence: Synthetic heavy chain variable region CDR3 amino acid sequence
AREPPVIAAGDFQH

SEQ ID NO: 1903 - protein, 14 aa, Artificial Sequence
  Description of Artificial Sequence: Synthetic heavy chain variable region CDR3 amino acid sequence
AREPPVIAAGDFSH

SEQ ID NO: 1904 - protein, 14 aa, Artificial Sequence
  Description of Artificial Sequence: Synthetic heavy chain variable region CDR3 amino acid sequence
ARDPPVIAAGDFQH

SEQ ID NO: 1905 - protein, 14 aa, Artificial Sequence
  Description of Artificial Sequence: Synthetic heavy chain variable region CDR3 amino acid sequence
ARGPPVIAADDFQH

SEQ ID NO: 1906 - protein, 14 aa, Artificial Sequence
  Description of Artificial Sequence: Synthetic heavy chain variable region CDR3 amino acid sequence
AREPPVIAAGDFPH

SEQ ID NO: 1907 - protein, 14 aa, Artificial Sequence
  Description of Artificial Sequence: Synthetic heavy chain variable region CDR3 amino acid sequence
AREQFKWNDFYFDY

SEQ ID NO: 1908 - protein, 14 aa, Artificial Sequence
  Description of Artificial Sequence: Synthetic heavy chain variable region CDR3 amino acid sequence
AKEGYNWNDYYFDY

SEQ ID NO: 1909 - protein, 14 aa, Artificial Sequence
  Description of Artificial Sequence: Synthetic heavy chain variable region CDR3 amino acid sequence
ARGFYKWNDWSFDY

SEQ ID NO: 1910 - protein, 15 aa, Artificial Sequence
  Description of Artificial Sequence: Synthetic heavy chain variable region CDR3 amino acid sequence
AREPPSLSAAATLDY

SEQ ID NO: 1911 - protein, 15 aa, Artificial Sequence
  Description of Artificial Sequence: Synthetic heavy chain variable region CDR3 amino acid sequence
ARDPPSEGAAGLFDY

SEQ ID NO: 1912 - protein, 15 aa, Artificial Sequence
  Description of Artificial Sequence: Synthetic heavy chain variable region CDR3 amino acid sequence
AREPPSDTAAGTGDY

SEQ ID NO: 1913 - protein, 14 aa, Artificial Sequence
  Description of Artificial Sequence: Synthetic heavy chain variable region CDR3 amino acid sequence
ARDPPAVAASFMDV

SEQ ID NO: 1914 - protein, 15 aa, Artificial Sequence
  Description of Artificial Sequence: Synthetic heavy chain variable region CDR3 amino acid sequence
VRDTPAIAGAATLDF

SEQ ID NO: 1915 - protein, 15 aa, Artificial Sequence
  Description of Artificial Sequence: Synthetic heavy chain variable region CDR3 amino acid sequence
AREPPSTTAAATSDY

SEQ ID NO: 1916 - protein, 14 aa, Artificial Sequence
  Description of Artificial Sequence: Synthetic heavy chain variable region CDR3 amino acid sequence
ARDVPVEAATSPEF

SEQ ID NO: 1917 - protein, 14 aa, Artificial Sequence
  Description of Artificial Sequence: Synthetic heavy chain variable region CDR3 amino acid sequence
ARDVPVIAAHTFEY

SEQ ID NO: 1918 - protein, 14 aa, Artificial Sequence
  Description of Artificial Sequence: Synthetic heavy chain variable region CDR3 amino acid sequence
AREMGVDAAATFDY

SEQ ID NO: 1919 - protein, 15 aa, Artificial Sequence
  Description of Artificial Sequence: Synthetic heavy chain variable region CDR3 amino acid sequence
ARALMATAGGLAFDI

SEQ ID NO: 1920 - protein, 15 aa, Artificial Sequence
  Description of Artificial Sequence: Synthetic heavy chain variable region CDR3 amino acid sequence
ARVLVATAYGNAFDI

SEQ ID NO: 1921 - protein, 14 aa, Artificial Sequence
  Description of Artificial Sequence: Synthetic heavy chain variable region CDR3 amino acid sequence
VSLYSDYDYGALDY

SEQ ID NO: 1922 - protein, 14 aa, Artificial Sequence
  Description of Artificial Sequence: Synthetic heavy chain variable region CDR3 amino acid sequence
VSLFGDYDYGALDY

SEQ ID NO: 1923 - protein, 14 aa, Artificial Sequence
  Description of Artificial Sequence: Synthetic heavy chain variable region CDR3 amino acid sequence
VTLYTDYDYGAPDH

SEQ ID NO: 1924 - protein, 15 aa, Artificial Sequence
  Description of Artificial Sequence: Synthetic heavy chain variable region CDR3 amino acid sequence
ARVSSPMIRGYYLDY

SEQ ID NO: 1925 - protein, 15 aa, Artificial Sequence
  Description of Artificial Sequence: Synthetic heavy chain variable region CDR3 amino acid sequence
ARVDTPMVRGYYFDY

SEQ ID NO: 1926 - protein, 26 aa, Artificial Sequence
  Description of Artificial Sequence: Synthetic heavy chain variable region FR1 amino acid sequence
EVQLVESGGGLVKPGGSLRLSCAASG

SEQ ID NO: 1927 - protein, 9 aa, Artificial Sequence
  Description of Artificial Sequence: Synthetic heavy chain variable region CDR1 amino acid sequence
VTVSSYYMT

SEQ ID NO: 1928 - protein, 14 aa, Artificial Sequence
  Description of Artificial Sequence: Synthetic heavy chain variable region FR2 amino acid sequence
WVRQAPGKGLEFIS

SEQ ID NO: 1929 - protein, 17 aa, Artificial Sequence
  Description of Artificial Sequence: Synthetic heavy chain variable region CDR2 amino acid sequence
DISSSSTYTNYADSVKG

SEQ ID NO: 1930 - protein, 30 aa, Artificial Sequence
  Description of Artificial Sequence: Synthetic heavy chain variable region FR3 amino acid sequence
RFTISRDNAKSSLYLQMNNLRAEDTAVYYC

SEQ ID NO: 1931 - protein, 15 aa, Artificial Sequence
  Description of Artificial Sequence: Synthetic heavy chain variable region CDR3 amino acid sequence
ARLGITVTGVGYFDL

SEQ ID NO: 1932 - protein, 11 aa, Artificial Sequence
  Description of Artificial Sequence: Synthetic heavy chain variable region FR4 amino acid sequence
WGRGTLVTVSS

SEQ ID NO: 1933 - protein, 26 aa, Artificial Sequence
  Description of Artificial Sequence: Synthetic heavy chain variable region FR1 amino acid sequence
QVQLVQSGTEVKKPGASVKVSCKASG

SEQ ID NO: 1934 - protein, 9 aa, Artificial Sequence
  Description of Artificial Sequence: Synthetic heavy chain variable region CDR1 amino acid sequence
YTFTNYDIS

SEQ ID NO: 1935 - protein, 14 aa, Artificial Sequence
  Description of Artificial Sequence: Synthetic heavy chain variable region FR2 amino acid sequence
WVRQAPGQGLEWMG

SEQ ID NO: 1936 - protein, 17 aa, Artificial Sequence
  Description of Artificial Sequence: Synthetic heavy chain variable region CDR2 amino acid sequence
WISGSTGNTIYAQNLQG

SEQ ID NO: 1937 - protein, 30 aa, Artificial Sequence
  Description of Artificial Sequence: Synthetic heavy chain variable region FR3 amino acid sequence
RLTMTTDTSTSTAYMELRSLRSDDTAIYYC

SEQ ID NO: 1938 - protein, 15 aa, Artificial Sequence
  Description of Artificial Sequence: Synthetic heavy chain variable region CDR3 amino acid sequence
ARDNVGYASGNYFDY

SEQ ID NO: 1939 - protein, 11 aa, Artificial Sequence
  Description of Artificial Sequence: Synthetic heavy chain variable region FR4 amino acid sequence
WGQGTLVTVSS

SEQ ID NO: 1940 - protein, 26 aa, Artificial Sequence
  Description of Artificial Sequence: Synthetic heavy chain variable region FR1 amino acid sequence
QVQLVQSGAEVKEPGASVKVSCKASG

SEQ ID NO: 1941 - protein, 9 aa, Artificial Sequence
  Description of Artificial Sequence: Synthetic heavy chain variable region CDR1 amino acid sequence
YTFTNYGIS

SEQ ID NO: 1942 - protein, 14 aa, Artificial Sequence
  Description of Artificial Sequence: Synthetic heavy chain variable region FR2 amino acid sequence
WVRQAPGQGLEWLG

SEQ ID NO: 1943 - protein, 17 aa, Artificial Sequence
  Description of Artificial Sequence: Synthetic heavy chain variable region CDR2 amino acid sequence
WISAYNGNIHYAQKVQG

SEQ ID NO: 1944 - protein, 30 aa, Artificial Sequence
  Description of Artificial Sequence: Synthetic heavy chain variable region FR3 amino acid sequence
RVTMTTDTSTSTGFMELRSLRSDDTAVYYC

SEQ ID NO: 1945 - protein, 14 aa, Artificial Sequence
  Description of Artificial Sequence: Synthetic heavy chain variable region CDR3 amino acid sequence
AREPPVIAAGDFQH

SEQ ID NO: 1946 - protein, 11 aa, Artificial Sequence
  Description of Artificial Sequence: Synthetic heavy chain variable region FR4 amino acid sequence
WGQGTLVTVSS

SEQ ID NO: 1947 - protein, 26 aa, Artificial Sequence
  Description of Artificial Sequence: Synthetic heavy chain variable region FR1 amino acid sequence
QVQLVQSGAEVKKPGASVKVSCKASG

SEQ ID NO: 1948 - protein, 9 aa, Artificial Sequence
  Description of Artificial Sequence: Synthetic heavy chain variable region CDR1 amino acid sequence
YTFTHYGIS

SEQ ID NO: 1949 - protein, 14 aa, Artificial Sequence
  Description of Artificial Sequence: Synthetic heavy chain variable region FR2 amino acid sequence
WVRQAPGQGLEWMG

SEQ ID NO: 1950 - protein, 17 aa, Artificial Sequence
  Description of Artificial Sequence: Synthetic heavy chain variable region CDR2 amino acid sequence
WISAYNGNTNYAQKLQG

SEQ ID NO: 1951 - protein, 30 aa, Artificial Sequence
  Description of Artificial Sequence: Synthetic heavy chain variable region FR3 amino acid sequence
RVTMTTDTSTSTAYMEVRSLRYDDTAVYYC

SEQ ID NO: 1952 - protein, 14 aa, Artificial Sequence
  Description of Artificial Sequence: Synthetic heavy chain variable region CDR3 amino acid sequence
ARDVPVEAATSPEF

SEQ ID NO: 1953 - protein, 11 aa, Artificial Sequence
  Description of Artificial Sequence: Synthetic heavy chain variable region FR4 amino acid sequence
WGQGTLVTVSS

SEQ ID NO: 1954 - protein, 26 aa, Artificial Sequence
  Description of Artificial Sequence: Synthetic heavy chain variable region FR1 amino acid sequence
EVQLVESGGGLVKPGGSLRLSCAASG

SEQ ID NO: 1955 - protein, 9 aa, Artificial Sequence
  Description of Artificial Sequence: Synthetic heavy chain variable region CDR1 amino acid sequence
FSFSSYQIN

SEQ ID NO: 1956 - protein, 14 aa, Artificial Sequence
  Description of Artificial Sequence: Synthetic heavy chain variable region FR2 amino acid sequence
WVRQAPGKGLEWVS

SEQ ID NO: 1957 - protein, 17 aa, Artificial Sequence
  Description of Artificial Sequence: Synthetic heavy chain variable region CDR2 amino acid sequence
SISGGSSYTDYADSIKG

SEQ ID NO: 1958 - protein, 30 aa, Artificial Sequence
  Description of Artificial Sequence: Synthetic heavy chain variable region FR3 amino acid sequence
RFTISRDNAKKSAFLQMKSLRADDTAVYYC

SEQ ID NO: 1959 - protein, 15 aa, Artificial Sequence
  Description of Artificial Sequence: Synthetic heavy chain variable region CDR3 amino acid sequence
ARALMATAGGLAFDI

SEQ ID NO: 1960 - protein, 11 aa, Artificial Sequence
  Description of Artificial Sequence: Synthetic heavy chain variable region FR4 amino acid sequence
WGQGTLVTVSS

SEQ ID NO: 1961 - protein, 26 aa, Artificial Sequence
  Description of Artificial Sequence: Synthetic heavy chain variable region FR1 amino acid sequence
QVQLVESGTHVKKPGASVKVSCEASD

SEQ ID NO: 1962 - protein, 9 aa, Artificial Sequence
  Description of Artificial Sequence: Synthetic heavy chain variable region CDR1 amino acid sequence
DTFNNKGIV

SEQ ID NO: 1963 - protein, 14 aa, Artificial Sequence
  Description of Artificial Sequence: Synthetic heavy chain variable region FR2 amino acid sequence
WVRQAPGQGLEWMG

SEQ ID NO: 1964 - protein, 17 aa, Artificial Sequence
  Description of Artificial Sequence: Synthetic heavy chain variable region CDR2 amino acid sequence
WIRPNNGNTKYAQKFQG

SEQ ID NO: 1965 - protein, 30 aa, Artificial Sequence
  Description of Artificial Sequence: Synthetic heavy chain variable region FR3 amino acid sequence
RVTMTTDASTNTAYMELRSLRSGDTAVYYC

SEQ ID NO: 1966 - protein, 14 aa, Artificial Sequence
  Description of Artificial Sequence: Synthetic heavy chain variable region CDR3 amino acid sequence
AREQFKWNDFYFDY

SEQ ID NO: 1967 - protein, 11 aa, Artificial Sequence
  Description of Artificial Sequence: Synthetic heavy chain variable region FR4 amino acid sequence
WGQGILVTVSS

SEQ ID NO: 1968 - protein, 26 aa, Artificial Sequence
  Description of Artificial Sequence: Synthetic heavy chain variable region FR1 amino acid sequence
QVQLVQSGGGVVQPGRSLRLSCAASG

SEQ ID NO: 1969 - protein, 9 aa, Artificial Sequence
  Description of Artificial Sequence: Synthetic heavy chain variable region CDR1 amino acid sequence
FTLSTYGMH

SEQ ID NO: 1970 - protein, 14 aa, Artificial Sequence
  Description of Artificial Sequence: Synthetic heavy chain variable region FR2 amino acid sequence
WVRQAPGKGLEWVA

SEQ ID NO: 1971 - protein, 17 aa, Artificial Sequence
  Description of Artificial Sequence: Synthetic heavy chain variable region CDR2 amino acid sequence
VIYYDESNKFYADSVQG

SEQ ID NO: 1972 - protein, 30 aa, Artificial Sequence
  Description of Artificial Sequence: Synthetic heavy chain variable region FR3 amino acid sequence
RFTISRDDSKNTLFLQMNSLRAEDTAVYYC

SEQ ID NO: 1973 - protein, 16 aa, Artificial Sequence
  Description of Artificial Sequence: Synthetic heavy chain variable region CDR3 amino acid sequence
ARESRPRGYSYSDFDS

SEQ ID NO: 1974 - protein, 11 aa, Artificial Sequence
  Description of Artificial Sequence: Synthetic heavy chain variable region FR4 amino acid sequence
WGQGTLVTVSS

SEQ ID NO: 1975 - protein, 26 aa, Artificial Sequence
  Description of Artificial Sequence: Synthetic heavy chain variable region FR1 amino acid sequence
EVQLVQSGAEVKKPGASVRVYCKASG

SEQ ID NO: 1976 - protein, 9 aa, Artificial Sequence
  Description of Artificial Sequence: Synthetic heavy chain variable region CDR1 amino acid sequence
YTFTTYYIH

SEQ ID NO: 1977 - protein, 14 aa, Artificial Sequence
  Description of Artificial Sequence: Synthetic heavy chain variable region FR2 amino acid sequence
WVRQAPGQGLEWMG

SEQ ID NO: 1978 - protein, 17 aa, Artificial Sequence
  Description of Artificial Sequence: Synthetic heavy chain variable region CDR2 amino acid sequence
MINPSGGTTSYAQKFQG

SEQ ID NO: 1979 - protein, 30 aa, Artificial Sequence
  Description of Artificial Sequence: Synthetic heavy chain variable region FR3 amino acid sequence
RLTMTGDTSTSTVYMELNYLRSEDTAVYYC

SEQ ID NO: 1980 - protein, 16 aa, Artificial Sequence
  Description of Artificial Sequence: Synthetic heavy chain variable region CDR3 amino acid sequence
TRDFIYFYGSGDGFDY

SEQ ID NO: 1981 - protein, 11 aa, Artificial Sequence
  Description of Artificial Sequence: Synthetic heavy chain variable region FR4 amino acid sequence
WGQGTLVTVSS

SEQ ID NO: 1982 - protein, 26 aa, Artificial Sequence
  Description of Artificial Sequence: Synthetic heavy chain variable region FR1 amino acid sequence
QVQLVQSGAEVKKPGSSVKVSCKASG

SEQ ID NO: 1983 - protein, 9 aa, Artificial Sequence
  Description of Artificial Sequence: Synthetic heavy chain variable region CDR1 amino acid sequence
GTFSTYTIN

SEQ ID NO: 1984 - protein, 14 aa, Artificial Sequence
  Description of Artificial Sequence: Synthetic heavy chain variable region FR2 amino acid sequence
WVRQAPGQGLEWMG

SEQ ID NO: 1985 - protein, 17 aa, Artificial Sequence
  Description of Artificial Sequence: Synthetic heavy chain variable region CDR2 amino acid sequence
RITPSLGVPLSAQKFQG

SEQ ID NO: 1986 - protein, 30 aa, Artificial Sequence
  Description of Artificial Sequence: Synthetic heavy chain variable region FR3 amino acid sequence
RITISADKSTTTAYMELSSLGSEDTAVYYC

SEQ ID NO: 1987 - protein, 18 aa, Artificial Sequence
  Description of Artificial Sequence: Synthetic heavy chain variable region CDR3 amino acid sequence
ASLNYYDTTDYYLGYSDS

SEQ ID NO: 1988 - protein, 11 aa, Artificial Sequence
  Description of Artificial Sequence: Synthetic heavy chain variable region FR4 amino acid sequence
WGQGTLVTVSS

SEQ ID NO: 1989 - protein, 25 aa, Artificial Sequence
  Description of Artificial Sequence: Synthetic heavy chain variable region FR1 amino acid sequence
VQLVESGGGLVKPGGSLRLSCAASG

SEQ ID NO: 1990 - protein, 9 aa, Artificial Sequence
  Description of Artificial Sequence: Synthetic heavy chain variable region CDR1 amino acid sequence
FAFNNYYMN

SEQ ID NO: 1991 - protein, 14 aa, Artificial Sequence
  Description of Artificial Sequence: Synthetic heavy chain variable region FR2 amino acid sequence
WVRQAPGKGLEWVS

SEQ ID NO: 1992 - protein, 17 aa, Artificial Sequence
  Description of Artificial Sequence: Synthetic heavy chain variable region CDR2 amino acid sequence
SISSASTYTDYADSVKG

SEQ ID NO: 1993 - protein, 30 aa, Artificial Sequence
  Description of Artificial Sequence: Synthetic heavy chain variable region FR3 amino acid sequence
RFTISRDNAKNSLYLHLNSLRAEDTAVYYC

SEQ ID NO: 1994 - protein, 18 aa, Artificial Sequence
  Description of Artificial Sequence: Synthetic heavy chain variable region CDR3 amino acid sequence
ARDYYGSGNYYNPKPLDV

SEQ ID NO: 1995 - protein, 11 aa, Artificial Sequence
  Description of Artificial Sequence: Synthetic heavy chain variable region FR4 amino acid sequence
WGQGTTVTVSS

SEQ ID NO: 1996 - protein, 26 aa, Artificial Sequence
  Description of Artificial Sequence: Synthetic heavy chain variable region FR1 amino acid sequence
EVQLLESGGGLVKPGGSLRLSCAASG

SEQ ID NO: 1997 - protein, 9 aa, Artificial Sequence
  Description of Artificial Sequence: Synthetic heavy chain variable region CDR1 amino acid sequence
FKFRSYSMN

SEQ ID NO: 1998 - protein, 14 aa, Artificial Sequence
  Description of Artificial Sequence: Synthetic heavy chain variable region FR2 amino acid sequence
WVRQAPGKGLEWVS

SEQ ID NO: 1999 - protein, 17 aa, Artificial Sequence
  Description of Artificial Sequence: Synthetic heavy chain variable region CDR2 amino acid sequence
SISSSSSYVDYAGSLKG

SEQ ID NO: 2000 - protein, 30 aa, Artificial Sequence
  Description of Artificial Sequence: Synthetic heavy chain variable region FR3 amino acid sequence
RFTISRDNAENSLYLQMNSLRAEDTAMYYC

SEQ ID NO: 2001 - protein, 15 aa, Artificial Sequence
  Description of Artificial Sequence: Synthetic heavy chain variable region CDR3 amino acid sequence
ARAGSVPVAGTYNDY

SEQ ID NO: 2002 - protein, 11 aa, Artificial Sequence
  Description of Artificial Sequence: Synthetic heavy chain variable region FR4 amino acid sequence
WGQGTLVTVSS

SEQ ID NO: 2003 - protein, 26 aa, Artificial Sequence
  Description of Artificial Sequence: Synthetic heavy chain variable region FR1 amino acid sequence
EVQLLESGGGVVQPGRSLRLSCAASG

SEQ ID NO: 2004 - protein, 9 aa, Artificial Sequence
  Description of Artificial Sequence: Synthetic heavy chain variable region CDR1 amino acid sequence
FSFRNYDMH

SEQ ID NO: 2005 - protein, 14 aa, Artificial Sequence
  Description of Artificial Sequence: Synthetic heavy chain variable region FR2 amino acid sequence
WVRQAPGKGLEWVA

SEQ ID NO: 2006 - protein, 16 aa, Artificial Sequence
  Description of Artificial Sequence: Synthetic heavy chain variable region CDR2 amino acid sequence
IISYDGSNKYADSVKG

SEQ ID NO: 2007 - protein, 30 aa, Artificial Sequence
  Description of Artificial Sequence: Synthetic heavy chain variable region FR3 amino acid sequence
RFTISRDTSKNTLYLQMNSLRVEDTAVYYC

SEQ ID NO: 2008 - protein, 17 aa, Artificial Sequence
  Description of Artificial Sequence: Synthetic heavy chain variable region CDR3 amino acid sequence
ARADSSGYYKGSEYFQH

SEQ ID NO: 2009 - protein, 11 aa, Artificial Sequence
  Description of Artificial Sequence: Synthetic heavy chain variable region FR4 amino acid sequence
WGQGTLVTVSS

SEQ ID NO: 2010 - protein, 26 aa, Artificial Sequence
  Description of Artificial Sequence: Synthetic heavy chain variable region FR1 amino acid sequence
QVQLVQSGGGLVQPGGSLRLSCAASG

SEQ ID NO: 2011 - protein, 9 aa, Artificial Sequence
  Description of Artificial Sequence: Synthetic heavy chain variable region CDR1 amino acid sequence
FTFSSYEMN

SEQ ID NO: 2012 - protein, 14 aa, Artificial Sequence
  Description of Artificial Sequence: Synthetic heavy chain variable region FR2 amino acid sequence
WVRQAPGKGLEWIS

SEQ ID NO: 2013 - protein, 17 aa, Artificial Sequence
  Description of Artificial Sequence: Synthetic heavy chain variable region CDR2 amino acid sequence
YISSSGDTKYYADSVKG

SEQ ID NO: 2014 - protein, 30 aa, Artificial Sequence
  Description of Artificial Sequence: Synthetic heavy chain variable region FR3 amino acid sequence
RFTVSRDNAKYSLYLQMDSLRAEDTAVYYC

SEQ ID NO: 2015 - protein, 15 aa, Artificial Sequence
  Description of Artificial Sequence: Synthetic heavy chain variable region CDR3 amino acid sequence
ASLYDSRGYYWVFDY

SEQ ID NO: 2016 - protein, 11 aa, Artificial Sequence
  Description of Artificial Sequence: Synthetic heavy chain variable region FR4 amino acid sequence
WGQGTLVTVSS

SEQ ID NO: 2017 - protein, 26 aa, Artificial Sequence
  Description of Artificial Sequence: Synthetic heavy chain variable region FR1 amino acid sequence
QVQLVQSGAEVKRPGASVKVSCKASG

SEQ ID NO: 2018 - protein, 9 aa, Artificial Sequence
  Description of Artificial Sequence: Synthetic heavy chain variable region CDR1 amino acid sequence
YIFSHYGIS

SEQ ID NO: 2019 - protein, 14 aa, Artificial Sequence
  Description of Artificial Sequence: Synthetic heavy chain variable region FR2 amino acid sequence
WVRQAPGQGLEWMA

SEQ ID NO: 2020 - protein, 17 aa, Artificial Sequence
  Description of Artificial Sequence: Synthetic heavy chain variable region CDR2 amino acid sequence
WISAYNGNTNYAQKLQG

SEQ ID NO: 2021 - protein, 30 aa, Artificial Sequence
  Description of Artificial Sequence: Synthetic heavy chain variable region FR3 amino acid sequence
RVTVTTDTSTSTAYMELRSLRSDDTAVYYC

SEQ ID NO: 2022 - protein, 15 aa, Artificial Sequence
  Description of Artificial Sequence: Synthetic heavy chain variable region CDR3 amino acid sequence
AREPPSLSAAATLDY

SEQ ID NO: 2023 - protein, 11 aa, Artificial Sequence
  Description of Artificial Sequence: Synthetic heavy chain variable region FR4 amino acid sequence
WGQGTLVTVSS

SEQ ID NO: 2024 - protein, 26 aa, Artificial Sequence
  Description of Artificial Sequence: Synthetic heavy chain variable region FR1 amino acid sequence
QVQLVQSGAEVRKPGESLKISCKASG

SEQ ID NO: 2025 - protein, 9 aa, Artificial Sequence
  Description of Artificial Sequence: Synthetic heavy chain variable region CDR1 amino acid sequence
YRFTNYWIG

SEQ ID NO: 2026 - protein, 14 aa, Artificial Sequence
  Description of Artificial Sequence: Synthetic heavy chain variable region FR2 amino acid sequence
WVRQMPGKGLEWMG

SEQ ID NO: 2027 - protein, 17 aa, Artificial Sequence
  Description of Artificial Sequence: Synthetic heavy chain variable region CDR2 amino acid sequence
VIYPGDSDTRYSPSFQG

SEQ ID NO: 2028 - protein, 30 aa, Artificial Sequence
  Description of Artificial Sequence: Synthetic heavy chain variable region FR3 amino acid sequence
QVTMSADKSTNTAYLQWSSLKASDTAIYYC

SEQ ID NO: 2029 - protein, 14 aa, Artificial Sequence
  Description of Artificial Sequence: Synthetic heavy chain variable region CDR3 amino acid sequence
VSLYSDYDYGALDY

SEQ ID NO: 2030 - protein, 11 aa, Artificial Sequence
  Description of Artificial Sequence: Synthetic heavy chain variable region FR4 amino acid sequence
WGQGTLVTVSS

SEQ ID NO: 2031 - protein, 26 aa, Artificial Sequence
  Description of Artificial Sequence: Synthetic heavy chain variable region FR1 amino acid sequence
QVQLVESGGDLVKPGGSLRLSCAASG

SEQ ID NO: 2032 - protein, 9 aa, Artificial Sequence
  Description of Artificial Sequence: Synthetic heavy chain variable region CDR1 amino acid sequence
FTLSGHYMS

SEQ ID NO: 2033 - protein, 14 aa, Artificial Sequence
  Description of Artificial Sequence: Synthetic heavy chain variable region FR2 amino acid sequence
WIRQPPGKGLEWVS

SEQ ID NO: 2034 - protein, 17 aa, Artificial Sequence
  Description of Artificial Sequence: Synthetic heavy chain variable region CDR2 amino acid sequence
SISGGSTYTNYADSVKG

SEQ ID NO: 2035 - protein, 30 aa, Artificial Sequence
  Description of Artificial Sequence: Synthetic heavy chain variable region FR3 amino acid sequence
RFTISRDNAENSLYLQMNSLRAEDTAVYYC

SEQ ID NO: 2036 - protein, 15 aa, Artificial Sequence
  Description of Artificial Sequence: Synthetic heavy chain variable region CDR3 amino acid sequence
ARLAYSDYGPFYFDL

SEQ ID NO: 2037 - protein, 11 aa, Artificial Sequence
  Description of Artificial Sequence: Synthetic heavy chain variable region FR4 amino acid sequence
WGRGTLVTVSS

SEQ ID NO: 2038 - protein, 26 aa, Artificial Sequence
  Description of Artificial Sequence: Synthetic heavy chain variable region FR1 amino acid sequence
EVQLLESGGGLVKPGGSLRLSCAASG

SEQ ID NO: 2039 - protein, 9 aa, Artificial Sequence
  Description of Artificial Sequence: Synthetic heavy chain variable region CDR1 amino acid sequence
FTFSDYTMN

SEQ ID NO: 2040 - protein, 14 aa, Artificial Sequence
  Description of Artificial Sequence: Synthetic heavy chain variable region FR2 amino acid sequence
WVRQAPGKGLEWVS

SEQ ID NO: 2041 - protein, 17 aa, Artificial Sequence
  Description of Artificial Sequence: Synthetic heavy chain variable region CDR2 amino acid sequence
SISITSSHIYYADSVKG

SEQ ID NO: 2042 - protein, 30 aa, Artificial Sequence
  Description of Artificial Sequence: Synthetic heavy chain variable region FR3 amino acid sequence
RFTISRDNAKNSLYLQINSLRAEDTAAYYC

SEQ ID NO: 2043 - protein, 19 aa, Artificial Sequence
  Description of Artificial Sequence: Synthetic heavy chain variable region CDR3 amino acid sequence
ARELGFASSSYSYYYGMDV

SEQ ID NO: 2044 - protein, 11 aa, Artificial Sequence
  Description of Artificial Sequence: Synthetic heavy chain variable region FR4 amino acid sequence
WGQGTTVTVSS

SEQ ID NO: 2045 - protein, 26 aa, Artificial Sequence
  Description of Artificial Sequence: Synthetic heavy chain variable region FR1 amino acid sequence
QVTLKESGGGVVQPGRSQRLSCTASG

SEQ ID NO: 2046 - protein, 9 aa, Artificial Sequence
  Description of Artificial Sequence: Synthetic heavy chain variable region CDR1 amino acid sequence
FNFHNYAMH

SEQ ID NO: 2047 - protein, 14 aa, Artificial Sequence
  Description of Artificial Sequence: Synthetic heavy chain variable region FR2 amino acid sequence
WVRQAPGKGLEWVA

SEQ ID NO: 2048 - protein, 17 aa, Artificial Sequence
  Description of Artificial Sequence: Synthetic heavy chain variable region CDR2 amino acid sequence
VISYDGSNKNFADSVKG

SEQ ID NO: 2049 - protein, 30 aa, Artificial Sequence
  Description of Artificial Sequence: Synthetic heavy chain variable region FR3 amino acid sequence
RFTISRDNSKNTLNLQMNNLRAEDTAVYYC

SEQ ID NO: 2050 - protein, 13 aa, Artificial Sequence
  Description of Artificial Sequence: Synthetic heavy chain variable region CDR3 amino acid sequence
VRDIVRGSPLFDY

SEQ ID NO: 2051 - protein, 11 aa, Artificial Sequence
  Description of Artificial Sequence: Synthetic heavy chain variable region FR4 amino acid sequence
WGQGTLVTVSS

SEQ ID NO: 2052 - protein, 26 aa, Artificial Sequence
  Description of Artificial Sequence: Synthetic heavy chain variable region FR1 amino acid sequence
QVQLVQSGGGVVQPGRSLKLSCAASG

SEQ ID NO: 2053 - protein, 9 aa, Artificial Sequence
  Description of Artificial Sequence: Synthetic heavy chain variable region CDR1 amino acid sequence
FTFKSYGMH

SEQ ID NO: 2054 - protein, 14 aa, Artificial Sequence
  Description of Artificial Sequence: Synthetic heavy chain variable region FR2 amino acid sequence
WVRQAPGKGLEWVA

SEQ ID NO: 2055 - protein, 17 aa, Artificial Sequence
  Description of Artificial Sequence: Synthetic heavy chain variable region CDR2 amino acid sequence
VISYDEINKYYADSVKG

SEQ ID NO: 2056 - protein, 29 aa, Artificial Sequence
  Description of Artificial Sequence: Synthetic heavy chain variable region FR3 amino acid sequence
FTISRDYSKNTLSLQMNSLTTEDTAMYYC

SEQ ID NO: 2057 - protein, 16 aa, Artificial Sequence
  Description of Artificial Sequence: Synthetic heavy chain variable region CDR3 amino acid sequence
AKPKTTGYYYLDAFDF

SEQ ID NO: 2058 - protein, 11 aa, Artificial Sequence
  Description of Artificial Sequence: Synthetic heavy chain variable region FR4 amino acid sequence
WGQGTMVTVSS

SEQ ID NO: 2059 - protein, 26 aa, Artificial Sequence
  Description of Artificial Sequence: Synthetic heavy chain variable region FR1 amino acid sequence
QVQLVQSGAEVKKPGASVKVSCKASG

SEQ ID NO: 2060 - protein, 9 aa, Artificial Sequence
  Description of Artificial Sequence: Synthetic heavy chain variable region CDR1 amino acid sequence
YTFTHYGIS

SEQ ID NO: 2061 - protein, 14 aa, Artificial Sequence
  Description of Artificial Sequence: Synthetic heavy chain variable region FR2 amino acid sequence
WVRQAPGQGLEWMA

SEQ ID NO: 2062 - protein, 17 aa, Artificial Sequence
  Description of Artificial Sequence: Synthetic heavy chain variable region CDR2 amino acid sequence
WISAYNGNTNYAQKLQD

SEQ ID NO: 2063 - protein, 30 aa, Artificial Sequence
  Description of Artificial Sequence: Synthetic heavy chain variable region FR3 amino acid sequence
RVTVTTDTSTSTAYMELRSLRSDDTALYYC

SEQ ID NO: 2064 - protein, 13 aa, Artificial Sequence
  Description of Artificial Sequence: Synthetic heavy chain variable region CDR3 amino acid sequence
ARDSMGGTTLFDY

SEQ ID NO: 2065 - protein, 11 aa, Artificial Sequence
  Description of Artificial Sequence: Synthetic heavy chain variable region FR4 amino acid sequence
WGQGTLVTVSS

SEQ ID NO: 2066 - protein, 25 aa, Artificial Sequence
  Description of Artificial Sequence: Synthetic heavy chain variable region FR1 amino acid sequence
VQLVQSGAEVKKPGESLKISCQVSR

SEQ ID NO: 2067 - protein, 9 aa, Artificial Sequence
  Description of Artificial Sequence: Synthetic heavy chain variable region CDR1 amino acid sequence
DTSTTYWIG

SEQ ID NO: 2068 - protein, 14 aa, Artificial Sequence
  Description of Artificial Sequence: Synthetic heavy chain variable region FR2 amino acid sequence
WVRQMPGKGLEWMG

SEQ ID NO: 2069 - protein, 17 aa, Artificial Sequence
  Description of Artificial Sequence: Synthetic heavy chain variable region CDR2 amino acid sequence
IIFPGDSDTRYSPSFQG

SEQ ID NO: 2070 - protein, 30 aa, Artificial Sequence
  Description of Artificial Sequence: Synthetic heavy chain variable region FR3 amino acid sequence
QVTISADKSIMTAYLQLTSLKASDTAMYYC

SEQ ID NO: 2071 - protein, 11 aa, Artificial Sequence
  Description of Artificial Sequence: Synthetic heavy chain variable region CDR3 amino acid sequence
ATQALRGAFDI

SEQ ID NO: 2072 - protein, 11 aa, Artificial Sequence
  Description of Artificial Sequence: Synthetic heavy chain variable region FR4 amino acid sequence
WGQGTMVTVSS

SEQ ID NO: 2073 - protein, 26 aa, Artificial Sequence
  Description of Artificial Sequence: Synthetic heavy chain variable region FR1 amino acid sequence
QVQLVQSGAEVKSPGSSATVSCKASG

SEQ ID NO: 2074 - protein, 9 aa, Artificial Sequence
  Description of Artificial Sequence: Synthetic heavy chain variable region CDR1 amino acid sequence
GTFGSYGIS

SEQ ID NO: 2075 - protein, 14 aa, Artificial Sequence
  Description of Artificial Sequence: Synthetic heavy chain variable region FR2 amino acid sequence
WVRQAPGQGLEWIG

SEQ ID NO: 2076 - protein, 17 aa, Artificial Sequence
  Description of Artificial Sequence: Synthetic heavy chain variable region CDR2 amino acid sequence
AIMPMFGTTNYAQKFQG

SEQ ID NO: 2077 - protein, 30 aa, Artificial Sequence
  Description of Artificial Sequence: Synthetic heavy chain variable region FR3 amino acid sequence
RVTMTADESTSTVYMDVSSLRPDDTAVYYC

SEQ ID NO: 2078 - protein, 24 aa, Artificial Sequence
  Description of Artificial Sequence: Synthetic heavy chain variable region CDR3 amino acid sequence
VRDVFYDILTGYYDADYYHHYMDV

SEQ ID NO: 2079 - protein, 11 aa, Artificial Sequence
  Description of Artificial Sequence: Synthetic heavy chain variable region FR4 amino acid sequence
WGKGTTVTVSS

SEQ ID NO: 2080 - protein, 26 aa, Artificial Sequence
  Description of Artificial Sequence: Synthetic heavy chain variable region FR1 amino acid sequence
QVQLVESGGRLVKPGGSLRLSCAASG

SEQ ID NO: 2081 - protein, 9 aa, Artificial Sequence
  Description of Artificial Sequence: Synthetic heavy chain variable region CDR1 amino acid sequence
FTFSDFYMS

SEQ ID NO: 2082 - protein, 14 aa, Artificial Sequence
  Description of Artificial Sequence: Synthetic heavy chain variable region FR2 amino acid sequence
WIRQAPGKGLEWVS

SEQ ID NO: 2083 - protein, 17 aa, Artificial Sequence
  Description of Artificial Sequence: Synthetic heavy chain variable region CDR2 amino acid sequence
YISSSGDDPNYADSVKG

SEQ ID NO: 2084 - protein, 30 aa, Artificial Sequence
  Description of Artificial Sequence: Synthetic heavy chain variable region FR3 amino acid sequence
RFTISRDNSKNSLYLQMNSLRAEDTAVYYC

SEQ ID NO: 2085 - protein, 18 aa, Artificial Sequence
  Description of Artificial Sequence: Synthetic heavy chain variable region CDR3 amino acid sequence
ARDEVGWNNLDYYFGMDV

SEQ ID NO: 2086 - protein, 11 aa, Artificial Sequence
  Description of Artificial Sequence: Synthetic heavy chain variable region FR4 amino acid sequence
WGQGTTVTVSS

SEQ ID NO: 2087 - protein, 26 aa, Artificial Sequence
  Description of Artificial Sequence: Synthetic heavy chain variable region FR1 amino acid sequence
EVQLVESGGGLVKPGGSLRLSCAASG

SEQ ID NO: 2088 - protein, 9 aa, Artificial Sequence
  Description of Artificial Sequence: Synthetic heavy chain variable region CDR1 amino acid sequence
FSFSSYAMN

SEQ ID NO: 2089 - protein, 14 aa, Artificial Sequence
  Description of Artificial Sequence: Synthetic heavy chain variable region FR2 amino acid sequence
WVRQAPGKGLQWVS

SEQ ID NO: 2090 - protein, 17 aa, Artificial Sequence
  Description of Artificial Sequence: Synthetic heavy chain variable region CDR2 amino acid sequence
SISAGSSYIDYADSVKG

SEQ ID NO: 2091 - protein, 30 aa, Artificial Sequence
  Description of Artificial Sequence: Synthetic heavy chain variable region FR3 amino acid sequence
RFTISRDNAENSLFLQMNSLRVEDTAVYYC

SEQ ID NO: 2092 - protein, 14 aa, Artificial Sequence
  Description of Artificial Sequence: Synthetic heavy chain variable region CDR3 amino acid sequence
ARVGSYTHGYEFDY

SEQ ID NO: 2093 - protein, 11 aa, Artificial Sequence
  Description of Artificial Sequence: Synthetic heavy chain variable region FR4 amino acid sequence
WGQGTLVTVSS

SEQ ID NO: 2094 - protein, 26 aa, Artificial Sequence
  Description of Artificial Sequence: Synthetic heavy chain variable region FR1 amino acid sequence
QVQLVESGGGVVQPGRSLRLSCAASG

SEQ ID NO: 2095 - protein, 9 aa, Artificial Sequence
  Description of Artificial Sequence: Synthetic heavy chain variable region CDR1 amino acid sequence
FTFSSYAMQ

SEQ ID NO: 2096 - protein, 14 aa, Artificial Sequence
  Description of Artificial Sequence: Synthetic heavy chain variable region FR2 amino acid sequence
WVRQAPGKGLEWVA

SEQ ID NO: 2097 - protein, 17 aa, Artificial Sequence
  Description of Artificial Sequence: Synthetic heavy chain variable region CDR2 amino acid sequence
VMTNDGDDKYYADSVRG

SEQ ID NO: 2098 - protein, 30 aa, Artificial Sequence
  Description of Artificial Sequence: Synthetic heavy chain variable region FR3 amino acid sequence
RFTISRDNSKNTLYLQMNNLRPEDTAVYYC

SEQ ID NO: 2099 - protein, 19 aa, Artificial Sequence
  Description of Artificial Sequence: Synthetic heavy chain variable region CDR3 amino acid sequence
ARDLFEWWELLGYCYAMDV

SEQ ID NO: 2100 - protein, 11 aa, Artificial Sequence
  Description of Artificial Sequence: Synthetic heavy chain variable region FR4 amino acid sequence
WGQGTTVTVSS

SEQ ID NO: 2101 - protein, 26 aa, Artificial Sequence
  Description of Artificial Sequence: Synthetic heavy chain variable region FR1 amino acid sequence
EVQLVESGGGLVKPGGSLRLSCAASG

SEQ ID NO: 2102 - protein, 9 aa, Artificial Sequence
  Description of Artificial Sequence: Synthetic heavy chain variable region CDR1 amino acid sequence
SSFSSYYMN

SEQ ID NO: 2103 - protein, 14 aa, Artificial Sequence
  Description of Artificial Sequence: Synthetic heavy chain variable region FR2 amino acid sequence
WVRQAPGKGLEWVS

SEQ ID NO: 2104 - protein, 17 aa, Artificial Sequence
  Description of Artificial Sequence: Synthetic heavy chain variable region CDR2 amino acid sequence
SISSSSTYIDYADSVKG

SEQ ID NO: 2105 - protein, 30 aa, Artificial Sequence
  Description of Artificial Sequence: Synthetic heavy chain variable region FR3 amino acid sequence
RFTISRDNAKNSLFLQMNSLRAEDTAVYYC

SEQ ID NO: 2106 - protein, 15 aa, Artificial Sequence
  Description of Artificial Sequence: Synthetic heavy chain variable region CDR3 amino acid sequence
ARVSSPMIRGYYLDY

SEQ ID NO: 2107 - protein, 11 aa, Artificial Sequence
  Description of Artificial Sequence: Synthetic heavy chain variable region FR4 amino acid sequence
WGQGTLVTVSS

SEQ ID NO: 2108 - protein, 26 aa, Artificial Sequence
  Description of Artificial Sequence: Synthetic heavy chain variable region FR1 amino acid sequence
QVQLVESGPGLVKPSETLSLTCTVSD

SEQ ID NO: 2109 - protein, 9 aa, Artificial Sequence
  Description of Artificial Sequence: Synthetic heavy chain variable region CDR1 amino acid sequence
DSITNNFWT

SEQ ID NO: 2110 - protein, 14 aa, Artificial Sequence
  Description of Artificial Sequence: Synthetic heavy chain variable region FR2 amino acid sequence
WIRQPPGKGLEWIG

SEQ ID NO: 2111 - protein, 16 aa, Artificial Sequence
  Description of Artificial Sequence: Synthetic heavy chain variable region CDR2 amino acid sequence
YIYYSGSTNYNPSLKS

SEQ ID NO: 2112 - protein, 30 aa, Artificial Sequence
  Description of Artificial Sequence: Synthetic heavy chain variable region FR3 amino acid sequence
RITMSVDLSKNQFSLKLSSVTAADTAVYYC

SEQ ID NO: 2113 - protein, 10 aa, Artificial Sequence
  Description of Artificial Sequence: Synthetic heavy chain variable region CDR3 amino acid sequence
ARLTSGGVDY

SEQ ID NO: 2114 - protein, 11 aa, Artificial Sequence
  Description of Artificial Sequence: Synthetic heavy chain variable region FR4 amino acid sequence
WGQGTLVTVSS

SEQ ID NO: 2115 - protein, 26 aa, Artificial Sequence
  Description of Artificial Sequence: Synthetic heavy chain variable region FR1 amino acid sequence
EVQLVESGGGLVKPGGSLRLSCAASG

SEQ ID NO: 2116 - protein, 9 aa, Artificial Sequence
  Description of Artificial Sequence: Synthetic heavy chain variable region CDR1 amino acid sequence
FSFSSYYMN

SEQ ID NO: 2117 - protein, 14 aa, Artificial Sequence
  Description of Artificial Sequence: Synthetic heavy chain variable region FR2 amino acid sequence
WVRQAPGKGLEWVS

SEQ ID NO: 2118 - protein, 17 aa, Artificial Sequence
  Description of Artificial Sequence: Synthetic heavy chain variable region CDR2 amino acid sequence
SISPSSSYTNYADSVKG

SEQ ID NO: 2119 - protein, 30 aa, Artificial Sequence
  Description of Artificial Sequence: Synthetic heavy chain variable region FR3 amino acid sequence
RFTISRDNAKDSLYLQMNSLRAEDTAVYYC

SEQ ID NO: 2120 - protein, 17 aa, Artificial Sequence
  Description of Artificial Sequence: Synthetic heavy chain variable region CDR3 amino acid sequence
ARDGLLGITIFGVVQDY

SEQ ID NO: 2121 - protein, 11 aa, Artificial Sequence
  Description of Artificial Sequence: Synthetic heavy chain variable region FR4 amino acid sequence
WGQGTLVTVSS

SEQ ID NO: 2122 - protein, 26 aa, Artificial Sequence
  Description of Artificial Sequence: Synthetic heavy chain variable region FR1 amino acid sequence
QVQLQQWGAGLLKPSETLSLTCAVYG

SEQ ID NO: 2123 - protein, 9 aa, Artificial Sequence
  Description of Artificial Sequence: Synthetic heavy chain variable region CDR1 amino acid sequence
DSFSGYFWT

SEQ ID NO: 2124 - protein, 14 aa, Artificial Sequence
  Description of Artificial Sequence: Synthetic heavy chain variable region FR2 amino acid sequence
WIRQPPGKGLEWIG

SEQ ID NO: 2125 - protein, 16 aa, Artificial Sequence
  Description of Artificial Sequence: Synthetic heavy chain variable region CDR2 amino acid sequence
EINLSGSTNYNPSLKS

SEQ ID NO: 2126 - protein, 30 aa, Artificial Sequence
  Description of Artificial Sequence: Synthetic heavy chain variable region FR3 amino acid sequence
RVTILVDTSKNQFSLKLSSVTAADTAVYYC

SEQ ID NO: 2127 - protein, 24 aa, Artificial Sequence
  Description of Artificial Sequence: Synthetic heavy chain variable region CDR3 amino acid sequence
ARGLHVSDDQDSSGYYFHPGSFDY

SEQ ID NO: 2128 - protein, 11 aa, Artificial Sequence
  Description of Artificial Sequence: Synthetic heavy chain variable region FR4 amino acid sequence
WGQGTLVTVSS

SEQ ID NO: 2129 - protein, 22 aa, Artificial Sequence
  Description of Artificial Sequence: Synthetic light chain variable region FR1 amino acid sequence
QPGLTQPPSVSGAPGQRVTISC

SEQ ID NO: 2130 - protein, 14 aa, Artificial Sequence
  Description of Artificial Sequence: Synthetic light chain variable region CDR1 amino acid sequence
TGSSSNIGAGYDVH

SEQ ID NO: 2131 - protein, 15 aa, Artificial Sequence
  Description of Artificial Sequence: Synthetic light chain variable region FR2 amino acid sequence
WYQQLPGTAPKLLIH

SEQ ID NO: 2132 - protein, 7 aa, Artificial Sequence
  Description of Artificial Sequence: Synthetic light chain variable region CDR2 amino acid sequence
DNNNRPS

SEQ ID NO: 2133 - protein, 32 aa, Artificial Sequence
  Description of Artificial Sequence: Synthetic light chain variable region FR3 amino acid sequence
GVPDRFSGSKSGTSASLAITGLQVEDEADYYC

SEQ ID NO: 2134 - protein, 11 aa, Artificial Sequence
  Description of Artificial Sequence: Synthetic light chain variable region CDR3 amino acid sequence
QSYDSSLSNYV

SEQ ID NO: 2135 - protein, 10 aa, Artificial Sequence
  Description of Artificial Sequence: Synthetic light chain variable region FR4 amino acid sequence
FGTGTKLTVL

SEQ ID NO: 2136 - protein, 22 aa, Artificial Sequence
  Description of Artificial Sequence: Synthetic light chain variable region FR1 amino acid sequence
SYVLTQPPSVSVAPGKTARIPC

SEQ ID NO: 2137 - protein, 11 aa, Artificial Sequence
  Description of Artificial Sequence: Synthetic light chain variable region CDR1 amino acid sequence
GGNNIGSKSVH

SEQ ID NO: 2138 - protein, 15 aa, Artificial Sequence
  Description of Artificial Sequence: Synthetic light chain variable region FR2 amino acid sequence
WYQQRPGQAPVLVIY

SEQ ID NO: 2139 - protein, 7 aa, Artificial Sequence
  Description of Artificial Sequence: Synthetic light chain variable region CDR2 amino acid sequence
YDSVRPS

SEQ ID NO: 2140 - protein, 32 aa, Artificial Sequence
  Description of Artificial Sequence: Synthetic light chain variable region FR3 amino acid sequence
GIPERFSGSNSGNTATLTISTVEAGDEADFYC

SEQ ID NO: 2141 - protein, 11 aa, Artificial Sequence
  Description of Artificial Sequence: Synthetic light chain variable region CDR3 amino acid sequence
QVWDSSRDHEV

SEQ ID NO: 2142 - protein, 10 aa, Artificial Sequence
  Description of Artificial Sequence: Synthetic light chain variable region FR4 amino acid sequence
FGGGTKLTVL

SEQ ID NO: 2143 - protein, 23 aa, Artificial Sequence
  Description of Artificial Sequence: Synthetic light chain variable region FR1 amino acid sequence
ETTLTQSPLSLPVTLGQPASISC

SEQ ID NO: 2144 - protein, 16 aa, Artificial Sequence
  Description of Artificial Sequence: Synthetic light chain variable region CDR1 amino acid sequence
RSSQSLVHSNGNTYLS

SEQ ID NO: 2145 - protein, 15 aa, Artificial Sequence
  Description of Artificial Sequence: Synthetic light chain variable region FR2 amino acid sequence
WFQQRPGQSPRRLIY

SEQ ID NO: 2146 - protein, 7 aa, Artificial Sequence
  Description of Artificial Sequence: Synthetic light chain variable region CDR2 amino acid sequence
RVSNRDS

SEQ ID NO: 2147 - protein, 32 aa, Artificial Sequence
  Description of Artificial Sequence: Synthetic light chain variable region FR3 amino acid sequence
GVPDRFSGSGSGTDFTLKISRVEAEDVGLYYC

SEQ ID NO: 2148 - protein, 9 aa, Artificial Sequence
  Description of Artificial Sequence: Synthetic light chain variable region CDR3 amino acid sequence
MQGTHWPPD

SEQ ID NO: 2149 - protein, 10 aa, Artificial Sequence
  Description of Artificial Sequence: Synthetic light chain variable region FR4 amino acid sequence
FGQGTRLEIK

SEQ ID NO: 2150 - protein, 23 aa, Artificial Sequence
  Description of Artificial Sequence: Synthetic light chain variable region FR1 amino acid sequence
DIVMTQTPLSLPVTLGQPASISC

SEQ ID NO: 2151 - protein, 16 aa, Artificial Sequence
  Description of Artificial Sequence: Synthetic light chain variable region CDR1 amino acid sequence
RSSQSLVYSDGNTYLS

SEQ ID NO: 2152 - protein, 15 aa, Artificial Sequence
  Description of Artificial Sequence: Synthetic light chain variable region FR2 amino acid sequence
WFQQRPGQSPRRLIY

SEQ ID NO: 2153 - protein, 7 aa, Artificial Sequence
  Description of Artificial Sequence: Synthetic light chain variable region CDR2 amino acid sequence
KVSNRDS

SEQ ID NO: 2154 - protein, 32 aa, Artificial Sequence
  Description of Artificial Sequence: Synthetic light chain variable region FR3 amino acid sequence
GVPNRFSGSGSGTDFTLKISRVEAEDVGVYYC

SEQ ID NO: 2155 - protein, 10 aa, Artificial Sequence
  Description of Artificial Sequence: Synthetic light chain variable region CDR3 amino acid sequence
VQNTHWPAYT

SEQ ID NO: 2156 - protein, 10 aa, Artificial Sequence
  Description of Artificial Sequence: Synthetic light chain variable region FR4 amino acid sequence
FGQGTKVEIK

SEQ ID NO: 2157 - protein, 22 aa, Artificial Sequence
  Description of Artificial Sequence: Synthetic light chain variable region FR1 amino acid sequence
QPVLTQPPSVSGAPGQRVTISC

SEQ ID NO: 2158 - protein, 14 aa, Artificial Sequence
  Description of Artificial Sequence: Synthetic light chain variable region CDR1 amino acid sequence
TGSGSNIGAGYDVH

SEQ ID NO: 2159 - protein, 15 aa, Artificial Sequence
  Description of Artificial Sequence: Synthetic light chain variable region FR2 amino acid sequence
WYQQVPGTAPKLLIL

SEQ ID NO: 2160 - protein, 7 aa, Artificial Sequence
  Description of Artificial Sequence: Synthetic light chain variable region CDR2 amino acid sequence
RNTNRPS

SEQ ID NO: 2161 - protein, 32 aa, Artificial Sequence
  Description of Artificial Sequence: Synthetic light chain variable region FR3 amino acid sequence
GVPDRFSGSKSGTSASLAITGLQAEDEADYYC

SEQ ID NO: 2162 - protein, 10 aa, Artificial Sequence
  Description of Artificial Sequence: Synthetic light chain variable region CDR3 amino acid sequence
QSYDRSLSVV

SEQ ID NO: 2163 - protein, 10 aa, Artificial Sequence
  Description of Artificial Sequence: Synthetic light chain variable region FR4 amino acid sequence
FGGGTKLTVL

SEQ ID NO: 2164 - protein, 22 aa, Artificial Sequence
  Description of Artificial Sequence: Synthetic light chain variable region FR1 amino acid sequence
SYELMQPPSVSVAPGQTATITC

SEQ ID NO: 2165 - protein, 11 aa, Artificial Sequence
  Description of Artificial Sequence: Synthetic light chain variable region CDR1 amino acid sequence
GGSNIGSETVH

SEQ ID NO: 2166 - protein, 15 aa, Artificial Sequence
  Description of Artificial Sequence: Synthetic light chain variable region FR2 amino acid sequence
WYQQKPGQAPVLVVH

SEQ ID NO: 2167 - protein, 7 aa, Artificial Sequence
  Description of Artificial Sequence: Synthetic light chain variable region CDR2 amino acid sequence
DDTDRPS

SEQ ID NO: 2168 - protein, 32 aa, Artificial Sequence
  Description of Artificial Sequence: Synthetic light chain variable region FR3 amino acid sequence
GIPERFSGSNSGNTATLTISGVEAGDEADFYC

SEQ ID NO: 2169 - protein, 11 aa, Artificial Sequence
  Description of Artificial Sequence: Synthetic light chain variable region CDR3 amino acid sequence
QVRDSRTDDVV

SEQ ID NO: 2170 - protein, 10 aa, Artificial Sequence
  Description of Artificial Sequence: Synthetic light chain variable region FR4 amino acid sequence
FGGGTKLTVL

SEQ ID NO: 2171 - protein, 22 aa, Artificial Sequence
  Description of Artificial Sequence: Synthetic light chain variable region FR1 amino acid sequence
QPGLTQPRSVSGSPGQSVTISC

SEQ ID NO: 2172 - protein, 14 aa, Artificial Sequence
  Description of Artificial Sequence: Synthetic light chain variable region CDR1 amino acid sequence
TGTSSDVGTFNYVS

SEQ ID NO: 2173 - protein, 15 aa, Artificial Sequence
  Description of Artificial Sequence: Synthetic light chain variable region FR2 amino acid sequence
WYQQHPGKAPKLMIY

SEQ ID NO: 2174 - protein, 7 aa, Artificial Sequence
  Description of Artificial Sequence: Synthetic light chain variable region CDR2 amino acid sequence
DVNQRPS

SEQ ID NO: 2175 - protein, 32 aa, Artificial Sequence
  Description of Artificial Sequence: Synthetic light chain variable region FR3 amino acid sequence
GVPDRFSGSKSGNTASLTISGLQAEDEADYYC

SEQ ID NO: 2176 - protein, 8 aa, Artificial Sequence
  Description of Artificial Sequence: Synthetic light chain variable region CDR3 amino acid sequence
CAYAGYYS

SEQ ID NO: 2177 - protein, 10 aa, Artificial Sequence
  Description of Artificial Sequence: Synthetic light chain variable region FR4 amino acid sequence
FGGGTKLTVL

SEQ ID NO: 2178 - protein, 23 aa, Artificial Sequence
  Description of Artificial Sequence: Synthetic light chain variable region FR1 amino acid sequence
EIVMTQSPSAMSASVGDRVTITC

SEQ ID NO: 2179 - protein, 11 aa, Artificial Sequence
  Description of Artificial Sequence: Synthetic light chain variable region CDR1 amino acid sequence
RASQGISNYLA

SEQ ID NO: 2180 - protein, 15 aa, Artificial Sequence
  Description of Artificial Sequence: Synthetic light chain variable region FR2 amino acid sequence
WFQQKPGKVPKRLIY

SEQ ID NO: 2181 - protein, 7 aa, Artificial Sequence
  Description of Artificial Sequence: Synthetic light chain variable region CDR2 amino acid sequence
AASSLQS

SEQ ID NO: 2182 - protein, 32 aa, Artificial Sequence
  Description of Artificial Sequence: Synthetic light chain variable region FR3 amino acid sequence
GVPSRFSGSGSGTEFTLTITSLQPEDFATYYC

SEQ ID NO: 2183 - protein, 9 aa, Artificial Sequence
  Description of Artificial Sequence: Synthetic light chain variable region CDR3 amino acid sequence
LQHNSYPFT

SEQ ID NO: 2184 - protein, 10 aa, Artificial Sequence
  Description of Artificial Sequence: Synthetic light chain variable region FR4 amino acid sequence
FGPGTKVEIK

SEQ ID NO: 2185 - protein, 23 aa, Artificial Sequence
  Description of Artificial Sequence: Synthetic light chain variable region FR1 amino acid sequence
DIVLTQTPATLSVSPGERATLSC

SEQ ID NO: 2186 - protein, 11 aa, Artificial Sequence
  Description of Artificial Sequence: Synthetic light chain variable region CDR1 amino acid sequence
RASHSVSNNLA

SEQ ID NO: 2187 - protein, 15 aa, Artificial Sequence
  Description of Artificial Sequence: Synthetic light chain variable region FR2 amino acid sequence
WYQQKPGQAPRLLIY

SEQ ID NO: 2188 - protein, 7 aa, Artificial Sequence
  Description of Artificial Sequence: Synthetic light chain variable region CDR2 amino acid sequence
SASTRAT

SEQ ID NO: 2189 - protein, 32 aa, Artificial Sequence
  Description of Artificial Sequence: Synthetic light chain variable region FR3 amino acid sequence
GIPARFSGRGSGTEFTLTISSLQPEDFAVYYC

SEQ ID NO: 2190 - protein, 11 aa, Artificial Sequence
  Description of Artificial Sequence: Synthetic light chain variable region CDR3 amino acid sequence
QQYNNWPPEYT

SEQ ID NO: 2191 - protein, 10 aa, Artificial Sequence
  Description of Artificial Sequence: Synthetic light chain variable region FR4 amino acid sequence
FGQGTKVDIK

SEQ ID NO: 2192 - protein, 22 aa, Artificial Sequence
  Description of Artificial Sequence: Synthetic light chain variable region FR1 amino acid sequence
QPVLTQPPSVSGAPGQRVTISC

SEQ ID NO: 2193 - protein, 14 aa, Artificial Sequence
  Description of Artificial Sequence: Synthetic light chain variable region CDR1 amino acid sequence
TGSSSNIGAGYDVH

SEQ ID NO: 2194 - protein, 15 aa, Artificial Sequence
  Description of Artificial Sequence: Synthetic light chain variable region FR2 amino acid sequence
WYRQFPGTAPELLIY

SEQ ID NO: 2195 - protein, 7 aa, Artificial Sequence
  Description of Artificial Sequence: Synthetic light chain variable region CDR2 amino acid sequence
GNTNRPS

SEQ ID NO: 2196 - protein, 32 aa, Artificial Sequence; identical to SEQ ID NO: 2161
  Description of Artificial Sequence: Synthetic light chain variable region FR3 amino acid sequence

SEQ ID NO: 2197 - protein, 10 aa, Artificial Sequence
  Description of Artificial Sequence: Synthetic light chain variable region CDR3 amino acid sequence
QSYDSSLKGV

SEQ ID NO: 2198 - protein, 10 aa, Artificial Sequence
  Description of Artificial Sequence: Synthetic light chain variable region FR4 amino acid sequence
FGGGTKLTVL

SEQ ID NO: 2199 - protein, 22 aa, Artificial Sequence
  Description of Artificial Sequence: Synthetic light chain variable region FR1 amino acid sequence
QSVLTQPPSVSGAPGQRVTISC

SEQ ID NO: 2200 - protein, 14 aa, Artificial Sequence
  Description of Artificial Sequence: Synthetic light chain variable region CDR1 amino acid sequence
TGSSSNIGAGYDVH

SEQ ID NO: 2201 - protein, 15 aa, Artificial Sequence
  Description of Artificial Sequence: Synthetic light chain variable region FR2 amino acid sequence
WYQHLPGTAPKLLIH

SEQ ID NO: 2202 - protein, 7 aa, Artificial Sequence
  Description of Artificial Sequence: Synthetic light chain variable region CDR2 amino acid sequence
GNNNRPA

SEQ ID NO: 2203 - protein, 32 aa, Artificial Sequence
  Description of Artificial Sequence: Synthetic light chain variable region FR3 amino acid sequence
GVPDRFSGSKSGTSASLVITGLQADDEADYYC

SEQ ID NO: 2204 - protein, 10 aa, Artificial Sequence
  Description of Artificial Sequence: Synthetic light chain variable region CDR3 amino acid sequence
QSYDRSLSVL

SEQ ID NO: 2205 - protein, 10 aa, Artificial Sequence
  Description of Artificial Sequence: Synthetic light chain variable region FR4 amino acid sequence
FGGGTKVTVL

SEQ ID NO: 2206 - protein, 22 aa, Artificial Sequence
  Description of Artificial Sequence: Synthetic light chain variable region FR1 amino acid sequence
SYELTQLPSVSVAPGQTARITC

SEQ ID NO: 2207 - protein, 11 aa, Artificial Sequence
  Description of Artificial Sequence: Synthetic light chain variable region CDR1 amino acid sequence
GGNNIGTKSVQ

SEQ ID NO: 2208 - protein, 15 aa, Artificial Sequence
  Description of Artificial Sequence: Synthetic light chain variable region FR2 amino acid sequence
WYQHKPGQAPVLVVY

SEQ ID NO: 2209 - protein, 7 aa, Artificial Sequence
  Description of Artificial Sequence: Synthetic light chain variable region CDR2 amino acid sequence
DDSDRPS

SEQ ID NO: 2210 - protein, 32 aa, Artificial Sequence
  Description of Artificial Sequence: Synthetic light chain variable region FR3 amino acid sequence
DIPERFSGSNSGNTATLTISRVEAGDEADYYC

SEQ ID NO: 2211 - protein, 11 aa, Artificial Sequence
  Description of Artificial Sequence: Synthetic light chain variable region CDR3 amino acid sequence
QVWDSSSDHYV

SEQ ID NO: 2212 - protein, 10 aa, Artificial Sequence
  Description of Artificial Sequence: Synthetic light chain variable region FR4 amino acid sequence
FGTGTKLTVL

SEQ ID NO: 2213 - protein, 23 aa, Artificial Sequence
  Description of Artificial Sequence: Synthetic light chain variable region FR1 amino acid sequence
DIVMTQSPSSLSASVGDRVTITC

SEQ ID NO: 2214 - protein, 11 aa, Artificial Sequence
  Description of Artificial Sequence: Synthetic light chain variable region CDR1 amino acid sequence
QASQDISTYLN

SEQ ID NO: 2215 - protein, 15 aa, Artificial Sequence
  Description of Artificial Sequence: Synthetic light chain variable region FR2 amino acid sequence
WYQHKPGKAPNLLIY

SEQ ID NO: 2216 - protein, 7 aa, Artificial Sequence
  Description of Artificial Sequence: Synthetic light chain variable region CDR2 amino acid sequence
DASNLEP

SEQ ID NO: 2217 - protein, 32 aa, Artificial Sequence
  Description of Artificial Sequence: Synthetic light chain variable region FR3 amino acid sequence
GVPSRFSGSGSGTDFTFTISSLQPEDIATYYC

SEQ ID NO: 2218 - protein, 9 aa, Artificial Sequence
  Description of Artificial Sequence: Synthetic light chain variable region CDR3 amino acid sequence
LQHDNLPPT

SEQ ID NO: 2219 - protein, 10 aa, Artificial Sequence
  Description of Artificial Sequence: Synthetic light chain variable region FR4 amino acid sequence
FGQGTKVDIK

SEQ ID NO: 2220 - protein, 23 aa, Artificial Sequence
  Description of Artificial Sequence: Synthetic light chain variable region FR1 amino acid sequence
EIVMTQSPLSLPVTLGQPASISC

SEQ ID NO: 2221 - protein, 16 aa, Artificial Sequence
  Description of Artificial Sequence: Synthetic light chain variable region CDR1 amino acid sequence
RSNQSLVYSDGNIYLS

SEQ ID NO: 2222 - protein, 15 aa, Artificial Sequence
  Description of Artificial Sequence: Synthetic light chain variable region FR2 amino acid sequence
WFQQRPGQSPRRLIY

SEQ ID NO: 2223 - protein, 7 aa, Artificial Sequence
  Description of Artificial Sequence: Synthetic light chain variable region CDR2 amino acid sequence
KVSNRDS

SEQ ID NO: 2224 - protein, 32 aa, Artificial Sequence
  Description of Artificial Sequence: Synthetic light chain variable region FR3 amino acid sequence
GVPDRFSGSGSGTDFTLKISRVEAEDVAVYYC

SEQ ID NO: 2225 - protein, 9 aa, Artificial Sequence
  Description of Artificial Sequence: Synthetic light chain variable region CDR3 amino acid sequence
MQVTHWPHE

SEQ ID NO: 2226 - protein, 10 aa, Artificial Sequence
  Description of Artificial Sequence: Synthetic light chain variable region FR4 amino acid sequence
FGQGTKLEIK

SEQ ID NO: 2227 - protein, 23 aa, Artificial Sequence
  Description of Artificial Sequence: Synthetic light chain variable region FR1 amino acid sequence
EIVMTQSPATLSVSPGERATLSC

SEQ ID NO: 2228 - protein, 11 aa, Artificial Sequence
  Description of Artificial Sequence: Synthetic light chain variable region CDR1 amino acid sequence
RASENVGRNLA

SEQ ID NO: 2229 - protein, 15 aa, Artificial Sequence
  Description of Artificial Sequence: Synthetic light chain variable region FR2 amino acid sequence
WYQQKPGQAPRLLIY

SEQ ID NO: 2230 - protein, 7 aa, Artificial Sequence
  Description of Artificial Sequence: Synthetic light chain variable region CDR2 amino acid sequence
GASIRAT

SEQ ID NO: 2231 - protein, 32 aa, Artificial Sequence
  Description of Artificial Sequence: Synthetic light chain variable region FR3 amino acid sequence
GILARFSGSGSGTEYTLTISSLQSEDFAVYYC

SEQ ID NO: 2232 - protein, 10 aa, Artificial Sequence
  Description of Artificial Sequence: Synthetic light chain variable region CDR3 amino acid sequence
QQYHDWPSFT

SEQ ID NO: 2233 - protein, 10 aa, Artificial Sequence
  Description of Artificial Sequence: Synthetic light chain variable region FR4 amino acid sequence
FGPGTKVDIK

SEQ ID NO: 2234 - protein, 22 aa, Artificial Sequence
  Description of Artificial Sequence: Synthetic light chain variable region FR1 amino acid sequence
QSVLTQPPSVSGAPGQRVTISC

SEQ ID NO: 2235 - protein, 14 aa, Artificial Sequence
  Description of Artificial Sequence: Synthetic light chain variable region CDR1 amino acid sequence
TGSSSNIGAGYDVH

SEQ ID NO: 2236 - protein, 15 aa, Artificial Sequence
  Description of Artificial Sequence: Synthetic light chain variable region FR2 amino acid sequence
WYQQLTGTAPKLLIF

SEQ ID NO: 2237 - protein, 7 aa, Artificial Sequence
  Description of Artificial Sequence: Synthetic light chain variable region CDR2 amino acid sequence
DNNNRPS

SEQ ID NO: 2238 - protein, 32 aa, Artificial Sequence; identical to SEQ ID NO: 2161
  Description of Artificial Sequence: Synthetic light chain variable region FR3 amino acid sequence

SEQ ID NO: 2239 - protein, 12 aa, Artificial Sequence
  Description of Artificial Sequence: Synthetic light chain variable region CDR3 amino acid sequence
QSYDSRLSAPYV

SEQ ID NO: 2240 - protein, 10 aa, Artificial Sequence
  Description of Artificial Sequence: Synthetic light chain variable region FR4 amino acid sequence
FGTGTKLTVL

SEQ ID NO: 2241 - protein, 22 aa, Artificial Sequence
  Description of Artificial Sequence: Synthetic light chain variable region FR1 amino acid sequence
QSALTQPRSVSGSPGQSVTISC

SEQ ID NO: 2242 - protein, 14 aa, Artificial Sequence
  Description of Artificial Sequence: Synthetic light chain variable region CDR1 amino acid sequence
TGTSSDVGDYNSVS

SEQ ID NO: 2243 - protein, 15 aa, Artificial Sequence
  Description of Artificial Sequence: Synthetic light chain variable region FR2 amino acid sequence
WYQQHPGTAPKLIIF

SEQ ID NO: 2244 - protein, 7 aa, Artificial Sequence
  Description of Artificial Sequence: Synthetic light chain variable region CDR2 amino acid sequence
DVTQRPS

SEQ ID NO: 2245 - protein, 31 aa, Artificial Sequence
  Description of Artificial Sequence: Synthetic light chain variable region FR3 amino acid sequence
GVPDRFSGSKSANTASLTISGLQPEDEADYY

SEQ ID NO: 2246 - protein, 9 aa, Artificial Sequence
  Description of Artificial Sequence: Synthetic light chain variable region CDR3 amino acid sequence
CCSFAGNYV

SEQ ID NO: 2247 - protein, 10 aa, Artificial Sequence
  Description of Artificial Sequence: Synthetic light chain variable region FR4 amino acid sequence
FGTGTKVTVL

SEQ ID NO: 2248 - protein, 22 aa, Artificial Sequence
  Description of Artificial Sequence: Synthetic light chain variable region FR1 amino acid sequence
QPVLTQPPSLSVAPGQTAWITC

SEQ ID NO: 2249 - protein, 11 aa, Artificial Sequence
  Description of Artificial Sequence: Synthetic light chain variable region CDR1 amino acid sequence
GGNNIGSKIVH

SEQ ID NO: 2250 - protein, 15 aa, Artificial Sequence
  Description of Artificial Sequence: Synthetic light chain variable region FR2 amino acid sequence
WYQQKPGQAPVVVVY

SEQ ID NO: 2251 - protein, 7 aa, Artificial Sequence
  Description of Artificial Sequence: Synthetic light chain variable region CDR2 amino acid sequence
DDDDRPS

SEQ ID NO: 2252 - protein, 32 aa, Artificial Sequence
  Description of Artificial Sequence: Synthetic light chain variable region FR3 amino acid sequence
GIPERFSGSNSGNTATLTIRRVEVGDEADYYC

SEQ ID NO: 2253 - protein, 11 aa, Artificial Sequence
  Description of Artificial Sequence: Synthetic light chain variable region CDR3 amino acid sequence
QVWDRSSDNYV

SEQ ID NO: 2254 - protein, 10 aa, Artificial Sequence
  Description of Artificial Sequence: Synthetic light chain variable region FR4 amino acid sequence
FGTGTKVSVL

SEQ ID NO: 2255 - protein, 23 aa, Artificial Sequence
  Description of Artificial Sequence: Synthetic light chain variable region FR1 amino acid sequence
ETTLTQSPSSLSASVGDRVTITC

SEQ ID NO: 2256 - protein, 11 aa, Artificial Sequence
  Description of Artificial Sequence: Synthetic light chain variable region CDR1 amino acid sequence
QASQDISNYLN

SEQ ID NO: 2257 - protein, 15 aa, Artificial Sequence
  Description of Artificial Sequence: Synthetic light chain variable region FR2 amino acid sequence
WYQQKPGKAPKLLIY

SEQ ID NO: 2258 - protein, 7 aa, Artificial Sequence
  Description of Artificial Sequence: Synthetic light chain variable region CDR2 amino acid sequence
DASNLET

SEQ ID NO: 2259 - protein, 32 aa, Artificial Sequence
  Description of Artificial Sequence: Synthetic light chain variable region FR3 amino acid sequence
GVPSRFSGSGSGTDFTFTISSLQSEDIATYYC

SEQ ID NO: 2260 - protein, 9 aa, Artificial Sequence
  Description of Artificial Sequence: Synthetic light chain variable region CDR3 amino acid sequence
QQHDNVPPT

SEQ ID NO: 2261 - protein, 10 aa, Artificial Sequence
  Description of Artificial Sequence: Synthetic light chain variable region FR4 amino acid sequence
FGQGTKVDIK

SEQ ID NO: 2262 - protein, 23 aa, Artificial Sequence
  Description of Artificial Sequence: Synthetic light chain variable region FR1 amino acid sequence
DIVLTQTPLSLPVTLGQPASISC

SEQ ID NO: 2263 - protein, 16 aa, Artificial Sequence
  Description of Artificial Sequence: Synthetic light chain variable region CDR1 amino acid sequence
RSSQSLVYSDGNTYLN

SEQ ID NO: 2264 - protein, 15 aa, Artificial Sequence
  Description of Artificial Sequence: Synthetic light chain variable region FR2 amino acid sequence
WFQQRPGQSPRRLIY

SEQ ID NO: 2265 - protein, 7 aa, Artificial Sequence
  Description of Artificial Sequence: Synthetic light chain variable region CDR2 amino acid sequence
KVSNRDS

SEQ ID NO: 2266 - protein, 32 aa, Artificial Sequence
  Description of Artificial Sequence: Synthetic light chain variable region FR3 amino acid sequence
GVPDRFTGSGSGTDFTLKISRVEAEDVGVYYC

SEQ ID NO: 2267 - protein, 11 aa, Artificial Sequence
  Description of Artificial Sequence: Synthetic light chain variable region CDR3 amino acid sequence
MQGTHWPPMYT

SEQ ID NO: 2268 - protein, 10 aa, Artificial Sequence
  Description of Artificial Sequence: Synthetic light chain variable region FR4 amino acid sequence
FGQGTKLEIK

SEQ ID NO: 2269 - protein, 23 aa, Artificial Sequence
  Description of Artificial Sequence: Synthetic light chain variable region FR1 amino acid sequence
DIRLTQSPSSLSASVGDRVTITC

SEQ ID NO: 2270 - protein, 11 aa, Artificial Sequence
  Description of Artificial Sequence: Synthetic light chain variable region CDR1 amino acid sequence
QASQDISNYLN

SEQ ID NO: 2271 - protein, 15 aa, Artificial Sequence
  Description of Artificial Sequence: Synthetic light chain variable region FR2 amino acid sequence
WYQQKPGKAPKLLIY

SEQ ID NO: 2272 - protein, 7 aa, Artificial Sequence
  Description of Artificial Sequence: Synthetic light chain variable region CDR2 amino acid sequence
DASYLET

SEQ ID NO: 2273 - protein, 32 aa, Artificial Sequence
  Description of Artificial Sequence: Synthetic light chain variable region FR3 amino acid sequence
GVPSRFSGSGSGTDFTFTISSLQPEDFATYYC

SEQ ID NO: 2274 - protein, 9 aa, Artificial Sequence
  Description of Artificial Sequence: Synthetic light chain variable region CDR3 amino acid sequence
QQYDDLLFT

SEQ ID NO: 2275 - protein, 10 aa, Artificial Sequence
  Description of Artificial Sequence: Synthetic light chain variable region FR4 amino acid sequence
FGPGTKLEIK

SEQ ID NO: 2276 - protein, 23 aa, Artificial Sequence
  Description of Artificial Sequence: Synthetic light chain variable region FR1 amino acid sequence
DIVMTQSPLSLPVTLGQPASISC

SEQ ID NO: 2277 - protein, 16 aa, Artificial Sequence
  Description of Artificial Sequence: Synthetic light chain variable region CDR1 amino acid sequence
RSGQSLVHSDGNTYLN

SEQ ID NO: 2278 - protein, 15 aa, Artificial Sequence
  Description of Artificial Sequence: Synthetic light chain variable region FR2 amino acid sequence
WFQQRPGQSPRRLIY

SEQ ID NO: 2279 - protein, 7 aa, Artificial Sequence
  Description of Artificial Sequence: Synthetic light chain variable region CDR2 amino acid sequence
KVSNRGS

SEQ ID NO: 2280 - protein, 32 aa, Artificial Sequence
  Description of Artificial Sequence: Synthetic light chain variable region FR3 amino acid sequence
GVPDRFSGSGSGTDFTLKISRVEAEDVGVYFC

SEQ ID NO: 2281 - protein, 9 aa, Artificial Sequence
  Description of Artificial Sequence: Synthetic light chain variable region CDR3 amino acid sequence
MQGTHWPRT

SEQ ID NO: 2282 - protein, 10 aa, Artificial Sequence
  Description of Artificial Sequence: Synthetic light chain variable region FR4 amino acid sequence
FGQGTKVDIK

SEQ ID NO: 2283 - protein, 23 aa, Artificial Sequence
  Description of Artificial Sequence: Synthetic light chain variable region FR1 amino acid sequence
DIVMTQSPLSLPVTLGQPASISC

SEQ ID NO: 2284 - protein, 16 aa, Artificial Sequence
  Description of Artificial Sequence: Synthetic light chain variable region CDR1 amino acid sequence
RSSQSLVHSDGNTYLS

SEQ ID NO: 2285 - protein, 15 aa, Artificial Sequence
  Description of Artificial Sequence: Synthetic light chain variable region FR2 amino acid sequence
WFHQRPGQSPRRLIY

SEQ ID NO: 2286 - protein, 7 aa, Artificial Sequence
  Description of Artificial Sequence: Synthetic light chain variable region CDR2 amino acid sequence
KVSNRDS

SEQ ID NO: 2287 - protein, 32 aa, Artificial Sequence
  Description of Artificial Sequence: Synthetic light chain variable region FR3 amino acid sequence
GVPNRFSGGGSGTDFTLKISRVEAEDVGFFYC

SEQ ID NO: 2288 - protein, 9 aa, Artificial Sequence
  Description of Artificial Sequence: Synthetic light chain variable region CDR3 amino acid sequence
MQGTHWQKT

SEQ ID NO: 2289 - protein, 10 aa, Artificial Sequence
  Description of Artificial Sequence: Synthetic light chain variable region FR4 amino acid sequence
FGQGTKVEIK

SEQ ID NO: 2290 - protein, 22 aa, Artificial Sequence
  Description of Artificial Sequence: Synthetic light chain variable region FR1 amino acid sequence
QPVLTQPPSVSGAPGQRVTISC

SEQ ID NO: 2291 - protein, 14 aa, Artificial Sequence
  Description of Artificial Sequence: Synthetic light chain variable region CDR1 amino acid sequence
TGSNSNIGAGYDVH

SEQ ID NO: 2292 - protein, 15 aa, Artificial Sequence
  Description of Artificial Sequence: Synthetic light chain variable region FR2 amino acid sequence
WYQQLPGTAPKLLIY

SEQ ID NO: 2293 - protein, 7 aa, Artificial Sequence
  Description of Artificial Sequence: Synthetic light chain variable region CDR2 amino acid sequence
ASTIRPS

SEQ ID NO: 2294 - protein, 32 aa, Artificial Sequence; identical to SEQ ID NO: 2161
  Description of Artificial Sequence: Synthetic light chain variable region FR3 amino acid sequence

SEQ ID NO: 2295 - protein, 10 aa, Artificial Sequence
  Description of Artificial Sequence: Synthetic light chain variable region CDR3 amino acid sequence
QSYDRNLSVV

SEQ ID NO: 2296 - protein, 10 aa, Artificial Sequence
  Description of Artificial Sequence: Synthetic light chain variable region FR4 amino acid sequence
FGGGTKVTVL

SEQ ID NO: 2297 - protein, 22 aa, Artificial Sequence
  Description of Artificial Sequence: Synthetic light chain variable region FR1 amino acid sequence
QSVLTQPPSASGSPGQSVTISC

SEQ ID NO: 2298 - protein, 14 aa, Artificial Sequence
  Description of Artificial Sequence: Synthetic light chain variable region CDR1 amino acid sequence
TGTSSDVGAYNYVS

SEQ ID NO: 2299 - protein, 15 aa, Artificial Sequence
  Description of Artificial Sequence: Synthetic light chain variable region FR2 amino acid sequence
WYQQHPGKAPKLIIY

SEQ ID NO: 2300 - protein, 7 aa, Artificial Sequence
  Description of Artificial Sequence: Synthetic light chain variable region CDR2 amino acid sequence
EVYKRPS

SEQ ID NO: 2301 - protein, 32 aa, Artificial Sequence
  Description of Artificial Sequence: Synthetic light chain variable region FR3 amino acid sequence
GVPDRFFGSKSGNTASLTVSGLQAEDEADYYC

SEQ ID NO: 2302 - protein, 11 aa, Artificial Sequence
  Description of Artificial Sequence: Synthetic light chain variable region CDR3 amino acid sequence
SSYAGSNTLGV

SEQ ID NO: 2303 - protein, 10 aa, Artificial Sequence
  Description of Artificial Sequence: Synthetic light chain variable region FR4 amino acid sequence
FGGGTKVTVL

SEQ ID NO: 2304 - protein, 22 aa, Artificial Sequence
  Description of Artificial Sequence: Synthetic light chain variable region FR1 amino acid sequence
QPVLTQPPSVSGAPGQRVTISC

SEQ ID NO: 2305 - protein, 14 aa, Artificial Sequence
  Description of Artificial Sequence: Synthetic light chain variable region CDR1 amino acid sequence
TGSSSNIGAGYDVH

SEQ ID NO: 2306 - protein, 15 aa, Artificial Sequence
  Description of Artificial Sequence: Synthetic light chain variable region FR2 amino acid sequence
WYQQLPGTAPKLVIH

SEQ ID NO: 2307 - protein, 7 aa, Artificial Sequence
  Description of Artificial Sequence: Synthetic light chain variable region CDR2 amino acid sequence
GNSNRPS

SEQ ID NO: 2308 - protein, 32 aa, Artificial Sequence
  Description of Artificial Sequence: Synthetic light chain variable region FR3 amino acid sequence
GVPDRFSGSKSGTSASLAITGLQGEDEADYYC

SEQ ID NO: 2309 - protein, 11 aa, Artificial Sequence
  Description of Artificial Sequence: Synthetic light chain variable region CDR3 amino acid sequence
QSYDSSLSGSV

SEQ ID NO: 2310 - protein, 10 aa, Artificial Sequence
  Description of Artificial Sequence: Synthetic light chain variable region FR4 amino acid sequence
FGGGTKLTVL

SEQ ID NO: 2311 - protein, 22 aa, Artificial Sequence
  Description of Artificial Sequence: Synthetic light chain variable region FR1 amino acid sequence
QSVLTQPPSLSGAPGQRVTISC

SEQ ID NO: 2312 - protein, 14 aa, Artificial Sequence
  Description of Artificial Sequence: Synthetic light chain variable region CDR1 amino acid sequence
TGSSSNIGADYHVH

SEQ ID NO: 2313 - protein, 15 aa, Artificial Sequence
  Description of Artificial Sequence: Synthetic light chain variable region FR2 amino acid sequence
WYQQLPGTAPKLLIY

SEQ ID NO: 2314 - protein, 7 aa, Artificial Sequence
  Description of Artificial Sequence: Synthetic light chain variable region CDR2 amino acid sequence
QNTNRPS

SEQ ID NO: 2315 - protein, 32 aa, Artificial Sequence
  Description of Artificial Sequence: Synthetic light chain variable region FR3 amino acid sequence
GVPDRFSASKSGTSVSLAITGLQAEDEADYYC

SEQ ID NO: 2316 - protein, 11 aa, Artificial Sequence
  Description of Artificial Sequence: Synthetic light chain variable region CDR3 amino acid sequence
QSYDSSLSAWV

SEQ ID NO: 2317 - protein, 10 aa, Artificial Sequence
  Description of Artificial Sequence: Synthetic light chain variable region FR4 amino acid sequence
FGGGTKLTVL

SEQ ID NO: 2318 - protein, 22 aa, Artificial Sequence
  Description of Artificial Sequence: Synthetic light chain variable region FR1 amino acid sequence
QSVVTQPPSVSGAPGQRVTISC

SEQ ID NO: 2319 - protein, 14 aa, Artificial Sequence
  Description of Artificial Sequence: Synthetic light chain variable region CDR1 amino acid sequence
TGSSSNIGAGYDVH

SEQ ID NO: 2320 - protein, 15 aa, Artificial Sequence
  Description of Artificial Sequence: Synthetic light chain variable region FR2 amino acid sequence
WYQQLPGTAPKLLIY

SEQ ID NO: 2321 - protein, 7 aa, Artificial Sequence
  Description of Artificial Sequence: Synthetic light chain variable region CDR2 amino acid sequence
GNTNRPS

SEQ ID NO: 2322 - protein, 32 aa, Artificial Sequence
  Description of Artificial Sequence: Synthetic light chain variable region FR3 amino acid sequence
GVPDRFSASKSGTSASLAITGLQAEDEADYYC

SEQ ID NO: 2323 - protein, 10 aa, Artificial Sequence
  Description of Artificial Sequence: Synthetic light chain variable region CDR3 amino acid sequence
QSYDSSLSVV

SEQ ID NO: 2324 - protein, 10 aa, Artificial Sequence
  Description of Artificial Sequence: Synthetic light chain variable region FR4 amino acid sequence
FGGGTKLTVL

SEQ ID NO: 2325 - protein, 23 aa, Artificial Sequence
  Description of Artificial Sequence: Synthetic light chain variable region FR1 amino acid sequence
DIRMTQSPDSLAVSLGERATINC

SEQ ID NO: 2326 - protein, 17 aa, Artificial Sequence
  Description of Artificial Sequence: Synthetic light chain variable region CDR1 amino acid sequence
KSSQSVLYSSNNKNYLA

SEQ ID NO: 2327 - protein, 15 aa, Artificial Sequence
  Description of Artificial Sequence: Synthetic light chain variable region FR2 amino acid sequence
WYQQKPGQPPKLLIN

SEQ ID NO: 2328 - protein, 7 aa, Artificial Sequence
  Description of Artificial Sequence: Synthetic light chain variable region CDR2 amino acid sequence
WASTRES

SEQ ID NO: 2329 - protein, 32 aa, Artificial Sequence
  Description of Artificial Sequence: Synthetic light chain variable region FR3 amino acid sequence
GVPDRFSGSGSGTDFTLAISSLQAEDVAVYYC

SEQ ID NO: 2330 - protein, 9 aa, Artificial Sequence
  Description of Artificial Sequence: Synthetic light chain variable region CDR3 amino acid sequence
QQYYSTPLT

SEQ ID NO: 2331 - protein, 10 aa, Artificial Sequence
  Description of Artificial Sequence: Synthetic light chain variable region FR4 amino acid sequence
FGGGTKVEIK

What is claimed is:

1. A composition comprising an antibody component, wherein:
    the antibody component consists of:
        a first antibody, or antigen binding fragment thereof, that has heavy and light chain CDRs found in antibody number 843; and
        a second antibody, or antigen binding fragment thereof, that has heavy and light chain CDRs found in an antibody that is selected from the group consisting of antibody numbers 554, 466, 2, 71, 112, 217, 227, 228, 249, 467, 469, 470, 832, 471, 516, 527, 532, 543, 544, 551, 571, 578, 581, 592, 615, 641, 868, and 870;
    wherein each of the first and second antibodies, or antigen binding fragments thereof, specifically binds to and neutralizes RSV F; and
    further wherein the composition does not include any antibodies other than the antibody component.

2. The composition of claim 1, wherein either the first and/or second antibody has an IC50 of less than 300 pM for neutralization of RSV.

3. The composition of claim 1, wherein either the first and/or second antibody has an IC50 of less than 200 pM for neutralization of RSV.

4. The composition of claim 1, wherein either the first and/or second antibody has an IC50 of less than 100 pM for neutralization of RSV.

5. The composition of claim 1, wherein each of the first and second antibody is characterized by binding affinity to pre-F with a $k_D$ of less than 10 nM.

6. A method of treating an RSV infection in a mammal, comprising administering the composition of claim 1.

7. The method according to claim 6, wherein the method further comprises administering to the mammal an additional prophylactic or therapeutic agent.

8. The method according to claim 7, wherein the additional prophylactic or therapeutic agent is one or more of: an antiviral agent; a vaccine specific for RSV; a vaccine specific for influenza virus; a vaccine specific for metapneumovirus (MPV); an siRNA specific for a RSV antigen; an siRNA specific for a MPV antigen; a further anti-RSV antibody; an anti-MPV antibody; an anti-IL4R antibody; an anti-influenza antibody; and a NSAID.

9. The method according to claim 6, wherein the mammal is a human.

10. The composition of claim 1, wherein the first antibody has framework regions with at least 90% sequence identity to those of antibody number 843, and/or the second antibody has framework regions with at least 90% sequence identity to the framework regions of the antibody in which its heavy and light chain CDRs are found.

11. The composition of claim 1, wherein the first antibody and/or second antibody comprise a heavy chain IgG Fc region.

12. The composition of claim 11, wherein the heavy chain IgG Fc region is a variant associated with increased antibody serum half-life, improved stability, modified effector function, or a combination thereof.

13. The composition of claim 1, which composition consists of: the antibody component; and
    a carrier for parenteral administration.

14. The composition of claim 1, which composition is formulated for parenteral administration.

15. The composition of claim 13, which composition is in powder form.

16. The composition of claim 1, which composition is formulated for intravenous-, intramuscular-, intradermal-, transdermal-, intraperitoneal, intranasal-, inhalation, and/or subcutaneous-administration and/or intramuscular administration.

17. The composition of claim 14, disposed within a syringe.

18. The composition of claim 1, wherein the second antibody, or antigen binding fragment thereof, has heavy and light chain CDRs found in antibody number 554.

19. The composition of claim 1, wherein the second antibody, or antigen binding fragment thereof, has heavy and light chain CDRs found in antibody number 466.

20. The composition of claim 1, wherein the second antibody, or antigen binding fragment thereof, has heavy and light chain CDRs found in antibody number 2.

21. The composition of claim 1, wherein the second antibody, or antigen binding fragment thereof, has heavy and light chain CDRs found in antibody number 71.

22. The composition of claim 1, wherein the second antibody, or antigen binding fragment thereof, has heavy and light chain CDRs found in antibody number 112.

23. The composition of claim 1, wherein the second antibody, or antigen binding fragment thereof, has heavy and light chain CDRs found in antibody number 217.

24. The composition of claim 1, wherein the second antibody, or antigen binding fragment thereof, has heavy and light chain CDRs found in antibody number 227.

25. The composition of claim 1, wherein the second antibody, or antigen binding fragment thereof, has heavy and light chain CDRs found in antibody number 228.

26. The composition of claim 1, wherein the second antibody, or antigen binding fragment thereof, has heavy and light chain CDRs found in antibody number 249.

27. The composition of claim 1, wherein the second antibody, or antigen binding fragment thereof, has heavy and light chain CDRs found in antibody number 467.

28. The composition of claim 1, wherein the second antibody, or antigen binding fragment thereof, has heavy and light chain CDRs found in antibody number 469.

29. The composition of claim 1, wherein the second antibody, or antigen binding fragment thereof, has heavy and light chain CDRs found in antibody number 470.

30. The composition of claim 1, wherein the second antibody, or antigen binding fragment thereof, has heavy and light chain CDRs found in antibody number 832.

31. The composition of claim 1, wherein the second antibody, or antigen binding fragment thereof, has heavy and light chain CDRs found in antibody number 471.

32. The composition of claim 1, wherein the second antibody, or antigen binding fragment thereof, has heavy and light chain CDRs found in antibody number 516.

33. The composition of claim 1, wherein the second antibody, or antigen binding fragment thereof, has heavy and light chain CDRs found in antibody number 527.

34. The composition of claim 1, wherein the second antibody, or antigen binding fragment thereof, has heavy and light chain CDRs found in antibody number 532.

35. The composition of claim 1, wherein the second antibody, or antigen binding fragment thereof, has heavy and light chain CDRs found in antibody number 543.

36. The composition of claim 1, wherein the second antibody, or antigen binding fragment thereof, has heavy and light chain CDRs found in antibody number 544.

37. The composition of claim 1, wherein the second antibody, or antigen binding fragment thereof, has heavy and light chain CDRs found in antibody number 551.

38. The composition of claim 1, wherein the second antibody, or antigen binding fragment thereof, has heavy and light chain CDRs found in antibody number 571.

39. The composition of claim 1, wherein the second antibody, or antigen binding fragment thereof, has heavy and light chain CDRs found in antibody number 578.

40. The composition of claim 1, wherein the second antibody, or antigen binding fragment thereof, has heavy and light chain CDRs found in antibody number 581.

41. The composition of claim 1, wherein the second antibody, or antigen binding fragment thereof, has heavy and light chain CDRs found in antibody number 592.

42. The composition of claim 1, wherein the second antibody, or antigen binding fragment thereof, has heavy and light chain CDRs found in antibody number 615.

43. The composition of claim 1, wherein the second antibody, or antigen binding fragment thereof, has heavy and light chain CDRs found in antibody number 641.

44. The composition of claim 1, wherein the second antibody, or antigen binding fragment thereof, has heavy and light chain CDRs found in antibody number 868.

45. The composition of claim 1, wherein the second antibody, or antigen binding fragment thereof, has heavy and light chain CDRs found in antibody number 870.

\* \* \* \* \*